United States Patent 10,240,205 (METHODS FOR ASSESSING RISK OF DEVELOPING A VIRAL DISEASE USING A GENETIC TEST) - sequence listing, part 9

SEQ ID NO: 259 - DNA, 102874 bp, Homo sapiens
agaaaaatcctattggcattgaggaggtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagagccgggagcaaggatgtcaccccccgctcccccgccccccgttccaatcctaagataccggcaataatcttcaatcttgcttaaatcatctttgtttccaacacctagcactgtgcctggcacaggaggctctccataaatgtggttgaatttattgtgaaagaaataagaggagggggtcatttgattgatgttgtttagcgtgtccagaacatagaataaatagaactgattacattcaccctatcattcaacagagataatatactaacgatgaaggttccacaacttgtaatactagaagggatggtccgaaagaaataattcatccatctcttttccttcctctctctctcttatacacacacgcgtacacacacacacacacacgcacgcacacacacacacacaccatagccatttgcatcaaagcaagcagttccattttaaggttcaaaatgtcttctttgaatgtatcttttacacttccttttccaaaatcaggatttctacaaatgacacaggtaacttgatgtctactatttactgttccatacacacatatagtgactatatcagccatggcctggcaagtttgataagtgaagccattccattttttagaacaaaaaaatgataaaataaatatggagatgggattttttgagctgttttccaactactggtttggttagcaaaagtacacatacttgtgatttgtcaagttgaagatactattcttgactaagatgctaccgagtcggtgacagttttgaatcgtgactcttacatttgggggtaactaaacactgttttctcatggtgctttaaaaaatactctttctatgcacgttcagggagcctgctgttgtgtttccaaggtgataaaactctcagagctctcccagggagattccggtaaaccctgagactgatgaacccatgcttggggacttggtcctcaagtttcagggaactcaggtttggggcaagtcccaggaagcaaaggaacggagattgctaaactggtgtaagattagaggtgttattttaatcacaagaagctgttcaactcttgggtttcttttttaaaaattaatttcccatatccagaattgtaattggtagggtaacaggcaactggttttaccagtggagaggaataagaaaaggaagtaataaaaataccttttctggtgcttgtacagaagaagaataaaagagtttcccaaacacacaattagtagttgagtcagggagtctattcctcactaaaaatcatactgaagttataaatttagaaaacatgcccttcccccacaagacaaaatgacttaggaattgaatacaaaggtgagttagtcagtggctggaatgtatggtacagagctcctgaaccagtggattgctaactgttgctctcctctcctcctaggtgcaaggcagttgatacctggctgtgtttaaagagagagcatgccatacatatttcaaaacttgacatcccccatttcaaaatggagagtatcttacttttagagttgctgggataaatatattatttatttaaacatttcaaggttcaaaaaagaaaataatacgcctttggaatacagaaatatgttgaattattatgatctgtaattttttttttggtttttttttgtttgtttttttttgagatggagtctcgctctgtcacccaggctggagtgtagtggcttgatcttggctcactgcaagctctgcctcccgggttcatgccattctcctgcctcagcctcccgagtagctgggactacaggcgccaccacgccccactgatttttttgtattttaagtagagttggggtttcaatgtgttaacaggatggtcttgatctcctgacctcgtgatccccctgcctcggcctcccaaagtgctgggattacaggcgtgagccaccgcgccggccaatgatctgtaaatttttactcctaaatttttaggagctcaaaccttgcaatgaatcagaaatatctaggggtgcttgataatatgctgatttctgggcatcatcctcagagactctgaatctatagacctggggtaggccccagaaagtggcattccaacaagcatcccaggagattcagacgcaggtagcgggtggattatagcagcgggtggattacattttgaataactgtaacacatagtttctgtgatgggacaagctgtgtgaagtatcaggagcttatttctccattgcaagtttagatctggggtagaatctcagcgagagggcacaaagcttactctgtccttctggtctcgcttttaaactttattccttattttgtataacttcgtttaggcccagagaatgccaatgactaactgctcttaatacattaaattaaagctcattcaaaagcaggttaattaaaagaaattatctagccaactttttggtataaagcaaaatacagagttatactttctgctcaagtagcatgtagcttttaagaatatagactctaatgattgccattctaactggtgtgagctgatatctcattgtggttttgatttgcatttctctgatggccagtgatgatgagcattttttcatgtgtcttttggctacataaatgtcttcttttgagaagtgtctgttcatatcctttgcccactttttgatggggttgtttgtttttttcttgtaaatttgtttgagttcattgtggattcttgatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccatggcttttggtgttttagacatgaagtccttgcccatgcctatgtcctgaatggtaatgcctaggttttcttctagggtttttatggttttaggtctaacgtttaagtctttaatccatcttgaattaatttttgcataaggtgtaaggaagggatccagtttcagctttctacatatggctagccagttttcctagcaccatttattaaatagggaatcctttccccattgcttgtttttctcaggtttgtcaaagatcagatagttgtagataggcggcattatttctgagggctctgttctgttccattgatgtatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggagaaataggaatacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaactgtcgcaaggacaaaaaaccaaacactgcatgttctcactcatagatggaaattgaacaatgagaacacatggacacaggaaggggaacatcatactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataaaaaaaaaatatagactctaacatgtttaattcatttgcaaatatttaatcttgaggtaatgcatgctcaaatattactaagttgcctgattcttcccacatacatcagggtcaggttgacagtaaagatgcataaacatgccttgggccttttaatgcacacttacccagaaacaagagtgaggaagagattcattttgaggttgtgtcctggggtggcaggagcaagtccaatggaggaatagagacttgggttcaggtcagagtctctaccacttacctgtgctgagaccacaggtgagacctaacctgcctgagcctccgtttcctcatttgtagagtcagatttccttttgctatttattaaatgagataatgtatgaaaatgcctggcacttagtggatacttaacatgtaccatgttcattctattccctttgcctcctagcaaatccttaacctcttgctcactgtgatattttgcatgttttcacatggtgacatgccaagtggtagagaaggaagccacggcctgtgatgaactgtatggggtggtcacagaaccttagctttttattctcactgcttatgtcattgatcccctgggacccaaagatgcaccctggaagaaagatcaagaagcatttggtgctagattcactagcaagctatctttagtatctcttttagacttgacaatgtcattatttccactaacagatgaggaagttgagacttgagaagtcatgcattcagatacggtggtggtgtagctggattttgaattagtatggggcaaaggccatgttctctttactgtcgctgactgcttctctagggcacagtcctggacctcaaagaatctgcactttggcacgggagctaagacttgtagctgtaataaaagtgactcattcctgagccaaacactggggttttcaccggagataaattgatgaacaaagtatgcaaatactgccctgccctcttgaaactgatgatctagtaataaattaacagaatctgccatgacctatcagaacttgaactagttaggggaaggctttccctagcgtgaagtgacatcaaacttgcgatgtgaacaatgagaagttaagtaggtatattagtcaattttcacattggtgacaaaaacaacctgagactgggaagaaaaagaggtttaattggacttacagttccacatgactggggagcctcagaatcatggcaggaggtgaaagacacttcttacatggcggcagcaagagagaatgaggaagatgaaaaagcggaaactcctgataaacccatcagatctcgtgagacttattcactaccatgagaacagtatgggggaaactgcccccatgattcaagttatcgcccactgggttcctcccacaacatgtgggaattaggggagtacaattcaagatgagatttggatggaggcacatccaaaccataccaataggtaaggtggacagcattggaagtaaagaagagccttctaggttgagagaactgcctgtgactgcctgtgcaaaggtcctggggtaggaaggaatgaaacagtcaaggtagtcagagtccaaaggttgaggagaaggctaacacaggataaggcaggacaggtaggcagggctatgttatggagggcatcggggatggtgggattgtgtcatgattatattttgtggttataaaggtctaacttcaggataaatgcattgaagagaagttgagtgcaggcaaggaggtcagataggagcctgttgcagtatttaggtaaaatggaatgtggtttagatgagagaggcagtgtagttatcaactgagatatgaactcctaagagtacctctatcacttattacctatgtgaatttgatcaagttccttaccatttgtatctccaaatttctttatgcataaaataattactatggtctacctaatagggttgttgaaaggataaaatggattagtaagtgtaaaatatatagaataatgcctggcatgtagtacatgtccattagacttcagcggttattgtcagtaatgcagatggagaggtggatagaatcagtagctatttagatcaagttgactggatttgatgatagcttacatatgtaaggttggaaggtaagtgcatcaagagtgatcgcaaaatgtatgtaaatgtgtgtaaatagtacagtggggcacaagttgaccagtgataggaaaagcttcttgaaggaagtagtagctgaattggaccttttaggactggaacatgcaaaagaggattatatagccctggtgaaaagagtgacccaatgttcttcagttctgaagactgctgggaggaggaagagttctttctcacctgaggctactttaccagaagttctctcagtctaaatcacaaatcctagtgattgtgtatcatcctttcctccacttcctgccaagctcagcaactcaaaatatgctgttggtcctgagaaaggaaactgggctaatcccttccttctgaggctgctgaataggagcttggctttcatcagaaagatgctttcactcccaattattacaagatcatcttgcaaattcccattttctagaaggctgattgcttgttcagaatgctcatggcaaacactgttggttacccactcagcagtcatgacctctttttccttattaacacctgaatttgatcagtccatggtagactcagcctgtggatacatcatggtgtaagccagtcatggtaatcctatctccatttatcagatacttattcttccagcttcctggtagctgagggtgactagtgataatattctgacatacaggaagtttgctcagaagcttctaggatgtgggaagagaagccctgccttttttggatactctcatatgaagaaaagatacttggaactgctgctgccaccatgtgagactgtgaggaaaaggttaaggggatttcagagacaccatcccattttctaacatcactgagcagttgaactacccctacctggaactgtctactatcagacttctagacttccttttttttttttttttttttttttttgagatggagtttcactcttgttgcctaggctggggtgcagtggcgcgatcttagctcactgcaacatccgcctcctgggttcaagcgattctcctgcctcagcctcccgaggaggtgggattacgggcactcaccaccatggccagctaattttttgtatttttagtagagatggggtttcgccatgttgggcaggctggtcttgaactcctgacctcaggtgatccacccaccttggcctcccaaagtgttgggattacaggcgtgagccacggtagccagcccagacttcttttgtgagatatgaaatgtctttattgtctaaatctctgttagttgggtactgttcattgcagcccaatgcaccctcattactacactgcttttcaatgaacaatattttacactttacaagaataactaccttctccttcttctccttactggcctttccaggcacccatatcaatagtcaagcccagccaattttcctctgggatttctgtgtgcatattcacttccattgcccccatctaccctttagtgtctctgagctaaaatataacaggagacccttaactgttttctctcattctagtatttcccccacattactgaaaactcttttcttggaccatgggtagtatcatgtatctactcttctataaccatctatggctcactattgcctctaagtttcaaatgtcctggaagatgttctaggcatgacattatttggccccaacctgttctctaattctttctgttgcttcatttatctgtctggcaagtgggaataggattaccatgactgatttacaccatattgtatccatgagccaagggatgtctatccatgcaaatttctccctgttttccagcacatcatgtccttttatgcctccacattgttggcaccaatttctttgcctggaatagtcctcctttttatatccccatttccattttacttctatcaaaatgaaatcttgctcttcctttaaggcccagctctgatcttctctttttcacaaaggctttcacaaaggctttattcccaagttgaaataaattgccccttcctctgttcttccataaaatttttcatatatttcaaatcagtattttacaggtagttaagaacatggtttctagagtcagattatgtgaattcaaatcaaaactctgctacttactaggacaaattttctgacatagctgaacctcagcatcctcatttaaaaatgtggattaaggctgggtacagtggcccgcacctgtaatcctagcactttgggaggccgaggtgggctcatcacgaggtcaggagatcgagaccatcctggctaacatggtgaaactccatctctactaaaaatacaaaaaattagctgggtgtggtggcaggcgcctatagtcccagctactcgggaggctgaggcaggagaatcccttgaacccgggaggcagagcttgcagtgagctgagatcatgccactgcactccagcctgggcaacaagagcgaaactccgtctccaaaaaaaaaaaaaatgtggattaatagcaccttgatagagttgtgaggcaagtgagatagtgtgttgttattatttttctttctctgaagtagttattccaatttgcctttgattatacttagctttatagaatgttctcactcactgaaatgatttaaagtttttggaaaaagagagatgaactggagaaaaggtaacacttactaagtcatactgtatttcagacagtctgccaaatcccttacaaatcaacaaccttgagacaaggtaaggacaccatcatcatcatcatcatcatcatcatcatcatctctactttacaaatgaggaaacggaggctcggagagttacttggctgcagtcacagcaaataagtggcaaaggcaagactcagagccatgcctgtctgatgtccaaggtccgtgctctccaggagtctctgctgtcttctgtcatggagagggccaaaactctattgtcctaaggccccttcaacatttcatgttgttttagcacaaagtaggtggtcagtaaagtgtgttgaatgtgatgtgtaatacaaaaacgaggcaggcagatcacaagctcaggagttcaagaccagcctggccaacatggtgaaaccccgtctctactaaaaatacaaaaattagccaggcatgatggcaggtgcctgtaatcccagctactcaggaggctgagggggaagaactgcttgaaaccaggaggtggaggttgcagtgagccgaaattgtgccactgcactccagcctgggtgacagagtgagactccgtctcaaaaaaagaaaaagagaaaaaaaaatgagtgatagaacaaacctttctcagcaaaccccaccttaaaacccaactgtgtcaatatgagtttatttacagcccattgattcatgaattaaaaaaaaattgaaggccaaagcaatcacaaggtaattataatttaaagtgagttattctaaacttacatataatgatataagaattttaaaattccaagattctccagaagcttaaatggaaaaataaagtgcatcataatcatacattccccaccctcacacatgcacacccttatacactcatcaacaaaacacagttctggaagaagatattaaaataaaaacttaaataattacttttgtagattgggaatggagatttggagctatggaggataatttttatttttgtattgctagtttttaaaatttttgtcttgcttttataatttaaaaccaatttattttattttaaaatttgtattctttttcttaattgcagtaaaaaatgcataacttaaaattcaccattttaaagtatatgattcagtggcatttattgtattcagaatattgtacaactaccaccacactgaccatgatctagttcaagaatatattcatcagccgggcgcggtggctcatgcctataatcccagcactttcggaggccgaggcgggcggatcatgaggtcaggagatcgagaccatcctggccaacacggtaaaaccccgtctctactaaaaacaagaaaatatgaaaaaaaattagctgggcatggtggcgggcgcctgtagtcctagctactcggaagctgaggcaggagaatggccgaaacccgggaggcggagcttgcagtgagccgagatagcgctactgcactccagcctgggcaacagaacgagactctgtctcaaacaaaataaaacaaaacaaatatatatatatattcatcaccccaaagggaaactcattgcccattaagcagtcactccttatttcctctcttcacctctgcaacaatcactaatctgctttctctatccacttgcctattctggatatttcggatagatggacacatataatacataaccttttgtgtctggctttttagacttagcataatgtttttaaagctcatccatgttgtggcatgtgtcacaattcattcctttttatggctgaataatagtccattgtgtagatataccacattttgtttatcctttcatcagttgatggacatttgagttgtttctgccctttggctatttgtcagcagtgctgctataaatatttcatgcacatgtttaaaaaagcagctggttaaaaaaaatctttgtatggtttcccattgcctaaccgtgtgataaacccaggcctggccttgctgactgtttgcccaaccttccacgttgttaaattcctttgtgtctttgtccatgctcctttttcaccttccattcgctggatggatacacatttcaagactaaatttaggtgttacctcctcaatgaggtcattgctgacatagcttcctgccttccttccacaggcagagtgcagtggtacaatcttggctcactgcaatctccgcttcccaagttcaagcaattctccacccgccacctctcaagtagctgggactacaggtgtttgccactaattttttttttttttttgtatttttagtagagacaggatttcaccatgttggccaggccagtctcaaactcctgacctcaggtgatctgcccacctcggcctcccaaagtgctgggattataggcgtgagccaccgccccggcctgtgtcctactttctactcagtgcctccttacaactcttacttgatctcatgagtctccccaaaacctgagcttgaaggcaggttcacaactttatcacctttgtgttgacagcacttaacacatggtgggcactctgatgaatatttcttcaataactggtgcttggatttttttcaccacaggataaccaggttatcttccaaataaccagttgtttgaataagaactctggttttttctaatctagatgccaatgtatgtggttactgggagctgtaattagttttatgtcctggtgagtaattaagaaccctagaagagtacattttaattagaattctgagacctcatgaagttctcaaaggcctttaactctgactatgttaaggacttgcaataatgtagattataaaggcctgcttgcttcttttggttttgtattatggtttattaagtgtttgctttttcataagatggtaatttacttgaaatgttgcttgtaaatgccacttacaatttacagtcctggaacatggtagaccctccataagcaatagctcttgttatccatcgcctatccatcatagtactttacacagagcttttgcacaaaattagcattcaatgcatgcttttaaatgaaagaatgaatagaatgggtatatgctcttcacagagtagacaagaaatagttaatcaacattctcagatggttgtagccaatgtgcttgaagatgcaacacaagaagtaacatcgttggtgacttccacacactgatgcagagtttttctcctgagctatttaacctataaattgtttcctttcagcctgtgtagagtggtctcaggtaccctttaaccctttttggaaatgcaaaacacagaagccattcctggttcctagatgagtggggacacttgtgcctcctcaccttcctgcagagcgtggactcaatggtctgtggtgctactatgcttggagctcatgagagctgacaatagctgatggagagcaaggatctcaaggtcttagggataaaatggtaagcaaaagagatgcggttcctgccttatttgcactcggagtcaataatcaaattagtatggatcagtatacagtttctaaaaggaaaaaatgcagagtgctctggagatgcaaatcagaggacttggcttattttgaggagatgcttcaagaatgtaaccccaaagaagtcatgttggagctgagtctgaaggttaaatgggaattaactaggcagagagagggaggggaaaggcctatgcaaagacccagaggggaggaggaaccaggaaccaggtggcaaagaatggaggaggaggaggtggtggaactagatgagggcagagagaaacatagtcattcccgttagcccaagagccatggaaagcctacgaagggtgtcagaggaagataggtcagatttacaatttttttttttttttgagacagaatcttgctctgttgcccaggctggagtgcggtggcgtggtctcggcttactgcaagctccgcctcccgggttcacgccattctcctgcctcagcctccccagtagctgggactacaggcgcccgccaccacaaccagctaattttttgtatttttagtagagacagggtttcaccgtgctagccaggatggtctcgatctcctgacctcgtgatccgcccgcctcggcctcccaaagtgctgggattacaggcgtgagccaatgcgccctgacataggtcagatttacttctaaagaatatattaaaaataatttcagagtaaggagcagaatggagcagagcaagacttgctggaagagatgagttagaaaatgactgcagtggaccacaaaagagacaggtagatggtgatagacatggagagaaacagggagctctgtgagatgagaaggaggtaaatcaatgggatttgatgacaaaaatgggtacagaggaaagggaagagctttcctgggttttaggcttgtacaactggatggatatggtggctgtcactgagtttttgaagtcaaataaaacatagagacaaatctctgaaatgaaaacattttatttgggaagaaaaattgcaatttggggggcatgcacacagaccgactggccttcagtatgtcccatgaacaaagagaaagaagttttataaaaaagagaaatgttacatattgctctttgagaaagttcattggcattagtaaggtttgagggagctggcaagttttgattggtaagtgacagtaacaggtaaaattattcttttttttttttttggactgagtcttgctctgttgctcaggctggagtgcagtggcacgatctcggctcactgcaagctccacctcccgggttcacgccattctcctgcctcagcctccccagtagctgggactacaggtgcccgccaccatgcctggctaattttttgtatttttggtagagatggggtttcaccgtattagccaggatggtctccatctcctgaccttgtgatccacctgtgtgggcctcccaaagtgctgggattacaggcgtgagccaccatgcccggccaactattcttaaagtcacaggagattgtttcagcagctgttagataaaactgtttcaggtgcaggaggcagtttcaggtgcaggaggcagtttcagcagccaggcttgcatagaattacgttcttggagcaatgttttgttccctgagtgcttttactcctgacctctctgttttagttgggtatgacaagaatgacacatttgttgattaactttcacatagggaagagaagaagaggtccagccagggagggtggatccagaggtctgctttggtcatgctgagttgagatgcttttgtgacatctacatggagatttgaagcagatgttgacttgctggtctggagctcagaggagatatctgaacgggcgatataaaatgtagagtaaaggttgagaagacaacaggaactagactaattcctcttgttgagtttagagttaaagagaatgagtaggatgaggacaatccaaatatcagaggaagacaacgggagggtattgtcatagaaggcaagagatggggatacttcaagatggagggagcagtgcaggtgtcatgttactgagacataagaacaacactggaaaaatgtccagtggatttagaaacctcaggcaactgttgaccctaggaagcttatttcagcacagggagagggtggcaatcagcttgggttaggttttggaatgattggaagataaggacatgcagacagtaatcacagacaactcttttgagattaaaaaaatgtgtagtgttttatcatatgagaaaaataattgcttccaacagcaataaaatgtaaataagttacatacctgttattcccactgcttaagttatcagaggacttttatacaaacatttgcatttgtagcattctgaggaaaaaatgctctggctgggccgggcacagtggctcacgcctgtaatcccagcactttgggaggctgagtcaggcagatcatgaggtcaggagatcgagaccatcctggctaacatggtgaaaccctgtctctactaaaaatacaaaaaaaaaaaaattagctgggcgtggtggcgggcgcctgtagtcccagctactttggaggctgaggcaggagaatggcgtgaaaccgggaggcggagcttgcagtgagccaagatccagccactgcactccagcctgggctacagagcaagactccatctcaaaaaaaaaaaaaaaatgctctggctgtcctctggtcttcaaatactttgcttaggtttctgtgaatctttaaatttcaggtgacttaagtgcacattcaatctactgaatcacaattcacttgtgctcatattcctgtatttgtatgatttttcccagccttcctgtattgtatggtgaataacttctttccaaggacgtttcaaaagttaagaaagcatgctgctgttgcccatttacaaatatttaatttcaaaggatgccaaagcattggcaaatatatgtgtcagagcttagagttagttgcagccttcttaataatcattttactattttatttcagaaatataatctagcatttcagcgtcactggaaatcttggtaggtagtcagtatttttgtttggaagtacaggataccagcagtgaaacacttcattttattaacgtcaagcaagtaaggcattattttcctataaatgtgaggttgtttgaaatgaaaacaaacaaaaccaggtaagacgatagaagcagatgttttctctgtttaaaaatgcggttggtatgtgaggtatgtgtagggaatggctaaaaagaaaataaaaataaaatttaaaatgcaatttgggttgggcatggtgtctgatgcctgtaatcccagcactgtgggaggccgaggtgggcggatcatcggagatcaggagttcaagaccagcctggccaacatggtgaaaccccgtctctactaaaaatacaaaaattagccgggcatgatggcaggtgcctgtaatcccagctacttgggaggctgaggggggagaactgctcgaatccgggaggtggaggttgcagtgagctgagatcatgccattgcactccagcctgggtgacagagcaagactctgtctcaaaaaaaaaaaaaacaacaaaaaatgcggcttgttcctagttaagcattttaagatttcccccttccccaagggaagagagaaaatcttacccctccttctgttcttcccttctgggtgaatgactgtacaatgaagatttaatctagttgagaaaaacaacacataggtgactcacatacaacctttgtatgtatgaatggaggcttgtataatcatttgtttttcactgtcctgacaatcaagtgggaatgagaaaaataagatttatgctagatttatttcagttgcaattagaaggaaaactatccctgtgatctagacaggattggatgtttcaaaagtgccaaatcattgagcagatagagaaagtgagaagacaataagggaacaagatttggaaaggaaatgatttaacagttacgccagtgtcctcactcatatgcaggagttgaaaaagttgatcttatggagatagaaagcagaatgatagataccagagactgggaaggatgtgtgggtggggtgggggtgggggaatgaagagaggttagtcagtgggtagaagggcagctagatagaagttatcaacaacgtattctacatttcaaagtagctagaagacagaacttgaaatgttcccaacacatagaaataataaatactcaagatgagggatcaaataccctgacttgatcattacatattctatgcatgtaacaaatatcacatgtaccctataaatatgtaatatattatttataagtaaagaaacttaaaaatgtaattgtgccaatataaacttatgtatcaatttatatttgttcatgtcttttgacttctccacctttttgttcacactcttaatgcccttactctcttttctcgcctatatttaccatactcatcatttcctctagaaacaccttggttattctgtcctcaccaatttcctttttctcagagttttcatagatcagtccataatgccaatttggtgcttagaaacatatcattgtgcattgttctcgatttttcataggcagtaaattttattttctctaccagaaactaaattcttgacaggcaaagatgattttgaaactgacccaatagttccatagacaggtttttgttgttgttgttgttctgtttgtttgtttgtttttggataaacatagaaattgacgcttttggtcttaaagcctgaaacttacatttgttttatttgagttccttgtttaggaaatgacccccaggcctctcaaaagtatcaaagaactgaaactaaccagatattgcatccagacaatgaaatgccaggcctctcattcatcatgattgcttccttaacccctctggagttcctgttttctcatacctttcttccctgctatataaacccctcattttagtccatcagggagatagatttgagactgatctcccatctccttagctgcagcacctgattaaagccttcttccttgccaataatcgttgtctcagtggtgtttcggtaacaacttcttatatatttacctgaacccttagcagtttgatgagcatacatttaagaaataaaggattccttgaattgttatcagttgaaatgctgcatttctgaacatggcaaaaagtggtctaagaagcatagcttaagcaactttctgtccaccactggtttttctgcgcccagcctctgcctgcaatgtgtgattggcatacagcctctcacaggccctcagaatgtacaggtctaactttcacaaatgaacctggaagataatttgtaattttgtggaggtgtgtgttcaagagcagcacattggtgtgctaatcagtatcccttcaccagccagtgagccttgctgctcatcagcatcaatacctcagtgtaatgtcttgcccttatcatacatgcagaaactctcaagaagtagttgaaaaacaatcaaagcttagcattttagtaaaatgttacagtggttttgagaaaattgctgaccaaaggaagatgtgcacctatcaaagtagtaaatttttactagtgttgctgctgccataggctataagctccctgagagcagggattaggtcttactcacatcattccctagtgctggggtacatcacctgggagatagaatgtgctcagcatatatttgaggaatggctaaataaggaaatgattatttctaataaaaggaaaagattgggcagggtgaggtagcttgtgtctgtaatcccagcagattgggaggccaaagcaggaggatcacttgagcccaggagtttgagaccagcctgggcaacacagggagatccctctgtacaaaacaaacaaaaaaacacgagctgggcatagtggtgcgtgcctgtggtcccagctacgcaggaggcttaggtagagtacagcttgagcccaggaagctgcagtgaattgtgattgcaccactgcactccaaactgggcaacacactgagactttgtcttttttttttttttttttttttgagatagagtctcgctctcttgctgaggctggagtgcagtgatacgatctcagctcactgcaacctcttccttccaggttcaaatgattcttgtgtctcaaccacccaagtagctgggattacaggcatgcaccaccatgcccagctaatttttgtatttttagtagagttggttttgccatgttggccaggctggtctcagtctcctggctttaagtgatctgcccaccttggcctcccaaagtgctgataccctgtcttcaaacaaacaaatgaagaatgtatagcacttactatgtgccaggcactgctctaaatcttttacatatattaactcatttaatcattgcaacaaccctataaattaactattctttatctctatttttcagatgaggaaactgtgtcaccaacagtttgagtgccttgttgaaggtcacatagctggttactggtagagttatgatttataatccacatggtctgactttacatttaacagctctcatatggaataaattaaatgctatactgctattcagatatgtgggaagacatgaaagcctcaagatatagtcaccagcctctgttacaagcttgttgtttgtttttgcttttggctttttgtcttgccacggcaaactcctaagggattctggtaatttgttagcaaactttctaaacccttccaagactgccaaattgctaattcttaagcagttttcattgacactattacattgtttcatgtcagggctttagaagcaggtgaaatagatattggttttgggaagtgggggaaagctgactagtaattgatgaatggctagcatctttatacaggagaggaatttgcaaggcaagtaggtgggcttgttctgagtttcttttgttagtttcaggagttaggcttgttgaattaagtaaataaagctcacaatgtgctgatcatgtgaaacctaatgccaagtctatttctgagccactgtgaagaggacatagataaacaaggagggaggagtgtcaagtcacacaaaatatttcttactggacttggattttattttttaaatctattcttttggaaatagagccatgatctaacttaatgtggctactctgaatgcatgctttctccatgtccactctaatttctttgcaggttcgtataaattttgtaagtaggctttgtaaatcaaactgtggactaaatatcctggtgcgactctcaaattgctctctcaaattgcaggcacaaagtcttggaagttctgttgggcagaaacaaactggaccaacattttgcgtttctgttatcatccaacttcctatatgcagtcaatctgataacaaacaagctaatgagctcacactagaattagaaattataaaacatttggttttccaggggaactgggaatggttttgtaattaatgtgtcagaaggaaaactgaagcaaagaagttttcaattgcaccatatatgacagacaaaaaatgaaattaaatgcatccttcagctctgaggacagataatggtcctctgtatctaagcgtccaggaggaggtgttctctctattccatacatctgtgtcccagtgaccaaatgcaatgaagagagacaacttgtaaattaaacaaacacaatggggcataaagatttttcccctttaatattacgggatatgacaaagaagatcattttctggttgccgtaaaaatacaacagtaaagttgaattagacccgcagatttgattaatgaatgctgtgcttatgaaaacacataattattcctgagctcttggaatgaaccaagtgcggtagcttctggggcacttgtgcatattacttttaaagatagaatcctgcttggcaaaaatggctctcccagttctatataaaagatacagcaagaagcagtgaatgtatatatagacaaagagaaaaataaagctcatagctgtcttcataccagtatagatctttcttagcacataactagatttttgtggattttacaagttaaataatgtgaaaaatatatttgggcacaagccgggatcgctgagctatataaaagggattctatcactcagagagttgtgtgatcatgggctagtcagtatcctttgtcagtgggcctgtctccctcattcgtaaaatggatatggggaggcttactatttccttaccagccatttcaaatatatgtctcctgataacctttgcattttagagctcttcttttgttttcccatgagcaaatcagcaagagctacaagttagcaaacttttaaggagtgcttgctgtgtaccggcccatgataggtgataggggccacaaagatgaaggcgccttttctctctacccatgagatccagtgaggccaatgaattactattattgttgttgttgttgagataggccctcgctctgtcaccttggctgtagtgcagtggcgcgatcatagttcactgcagcctcaatcccctggggcacaagtgatcctcccacctcagcctcccaagtacctgggactacaggcgtgcaccaccatgcctagctaatttttgtatattttttagtgactgggttttgccacattgcccaggctggtctcaaacacctgagctctggcagtcctcccgcttcagcctcccaaagtgctgggattacaggcgtgagccaccatccaccgtgctctgggtcatttttttcagctctcttatagttcatatatactttctccggctattgtatattccatctgttaatcttgtcaaatctattgtatattccatctgttgaccttgctatagcaacaactataattttaattccttaagttccacttagttctttttcaaatttgcctgatcatttttgattgtctcttgttgcttattccattttatgattccattctttatttctttaagcataccatgtatatttgtgtatacttcgtatcagatcatctagactccttgagattctaaatctggactttgtagcttctgctagcctttacctgggatggtttgttccttttgattttggtgacctattttttatgggttcaattttggttaatcttaacctgggaaaatttggaggctgaaattaaagatgtgatcctccagaaaacattttttttttcctgttcagagatagtgaccattggggccaccatgcattttgtgtgggtttattgttcacggctcccatttcagcttagaatctctttttttcttcctcttttttcccctttaaccttcatattctcccttaggtcctgcaaagtgctacctaaaaggtcttgtacattataatgttattttataacttaaaggcccctcagggtatcttgcccaccatatttctaaaagtgaaattgctgatgttattgaatgcttaccctgtgccaagcattcttttgagcattttacttgtgttagctcatttaacactcacaacaacttcatgaggaaaagtaacattttttattctcatttcacaggtgaagaaattgaggtgcaatgcgattaagtaacaggttgccaatgttacacagctgatacatgctacatgagttgataatgttacacggcaaatagagctgggattgtaagaaacacctaaaaaatttatgcacatgataggaaattcaaagtgtacaaaaggctatatagtgaatagtaagtccttttctgttcctgtgccctagacatgccattgcccctcccaggaggcaattattaccagtttcttacgtatttttctaggggttgtgtacaaaacatacaatctaatatatatatatatataatagtatatcatatttattatacattatgtgtctgattttgctagaaaaatagaaataacaaaaagtaacatttcttgaatacttactctatgcttgttacttttcattcattatctcatttgttcttctgaggaattattagttttactttgtaagtgagaaattgagtattacaaaagttaagtaacttgcccaagaatttgcagatagtaagaagcagagctaggattcaaacctaggtcttcgtggttcttgggcctgcacactttggcttttcacagggagctgactaggggttgacatctttaactcctctgtagtggattaggacaagagttagagtaaaggctggggtttagggtttgcgctaggacctcctctctaacccctacaccatacctggatgtggcctgtgcaagtgtgttttaggattgctgcttcctggggaatgagatggagaacacaaaactcaaccttgcccatcttctctgcatctatatttgttagtttcatatgtttaaggataggcttttgttaaccaattactctattttgaaactccctcttctcttttcttctttttctaatttcttccttccttccaaccctcctgtaaacatttatttgagtgcctttatatgtctagcattctgtttggtgctggaaataccaagatacaagaacataactgtcttttgagaaggttgtactttagtggggagacaaataccctaactgcaaattataacacagtgagttaagtgtttgtactttcctatggctgccataacaaattattacaaacttggtggcttaagcaacacacgcagattctctcacatttctagaaatcagaaatttgaaatctgtttcactggtccaaaatcaaggtgtcaacagggctacagtctcctggaagctctagaggggaatctctagattctcctttgcttttccagtttctagagccacattccttttatgctgagttccaggaacttccctccatctccaaagccatgaatgcagcatcttgcgtaagtgatcacattgccttcttctggtgaaatactgctctgacttccccttcttttttttttttttttagatggagtctcgctgttgcccagcctggggtgcaatggtgcgatctcagctcactgcagcctctgcctcctgggttcaagtgattctccagcttcagcctcctgagtagctgggaatacaggcgtgtgccaccacgcccggctaatttttatatttttcggaggggcaggatttcaccatgttggctaggctggtctcaaactcctgacctcaagtgatccaaccgcctcagcctcccaaagtgctaggattacagacgtgagccaccaagcctagccctgacttccccttctaaggacacttgtgattgtatttagggtccaccctgctaatctgagataatcttcccatagccagatccataatttagctatgtctgcaaagtctcttttgccatataaggtaacattcacagatccctgacttttatagttctgttcttttgtcctcattttctcattctgtgagtgtgtgtgtgtgtatcctcaacagtttcctccagacctggtgtactagcaagttgtgtgggttcttcctcaaaataccacccatggggtatttctttttcttctctctctctgctcctctctacactggttgatgcccttattcagataaacattcaaatggtcagctaagggttctccctgtctctaagctctcctcccaacttaccttacaaccattgttccattaattgttctatgtgacccttgtttaaaaacttctagagaataaattctgaactccttagcatgacacttcaaggttctctggagttcaagacctatatcaacttcatttatttattcagcaggtgctcattaggatttctcatgtgttaagactgtgccaggcactgagagtatgatagtgggtaaaagtaggcatgtccacccttggggattttgctgtctaataggaaagacagatatgaataaaataataattatgaagaaatgtgaaattgcaactacaataaaacagcagctcagacttatgtaatgcctgccatccatctagcatcatcctaagaattttacatatactgtctcttgtaatcttcacagcttgttcataactgctacttcctactttatggatgagataacaggtgcagaaagtttaagtgattcaaattcacacagctggaaaggatttaagccaggtagcttggttctggattttgtgtatggaaccactgtcatattttgataaaagagaagtgcctggtgctatgaggatcgttaattgggagtgggaccagggtagaaagaagcacagagagaagcaaaactgcttcatgaatgatgtgttgaggaggtacacagcttgatggtaggccgggtctgttgggaactgttgaggttatatattgggaactgttgaggttatatatatatatatatagagagagagagagagagacagacagacagacagagacagagagacagagacagagtggggatggggaattggaaaagcttcctaaggaagggacagctaaactgaagttggaaatataccttggcattaattggacaggaagaaaggaaaagtgttccatccagagggaagatcatgtgtcaaggccgtatggaggcaaggagcagagtgcttagggggtctgaaatgggaccaggtggagccgagagagcaaaggcagagggaggagcaaggtataggatggctgcagtgggattaggctggggaggcaggtaggtgccaaatcacccaggaccctataggacatattataaaccattttctttatcctaaatgcaatgggaaaccattgccattgagtttttgttttgtttcatttttctgagatagggtctcactctgtcacccaggctggagtgcagtggtatgatcatagctcactgcagccttgaactcctgagctcaagcgatcttcctgcatcagccttccaaagtgctgggatcacaggggtgaaccaccacacccagccccattgaggttctattcagggggtacgacagagatgtgtcagaggtttctggattgtgccctgaattgatgtggtctcattctctggaacggaacccaggaaagagaacatgttcaggaataagatcatggactctgttttggacctgttgactttgagaaacacaaatgagatgtgaaggaaattttcaaatatttggatccagagttcatagaagatgtctgggctgggcctttaagtccagcccttgtgtcactgacttttggcaattgaaagatgaaccttttgaaggacttctatggtgctaaggagaattttaaattctacttgtgagactgcattaatcttttgttgtagatttgaatgtggggtgaaaatcagtcagagtgggaagaattaattttagagtccttccccactttctacttttacaacagaatacctttggataatcatttatccttcaataataggaactagtttttggaaattgtggtttgagtctgctataaggaaaccggcaagacaaaaaacaaataaccaaaaagctgtgtgagaaggcttcttaagactgcaatgtaacctcagtgttcaaggcaaaagggagtgtatttgttagctattgctgtataacaaattaccccaaaacttaggggcttgaaacaacaataaaaatgtattgtcctcacagtttctgtgcatccaggaatctgtgagcagtttagctgagtggcttgagctcaggaggtaagaggtcccaggcaagatgtcagtgagttcttcagtcattggaaagcttgactgaggttgtaggatccacttctgaggttaaaggtcattcacatgactgcaagctagtgttagctgttggcaggaatccttggtttcttgccacaagagcttctctcagagctacttgagtgttcttaccctatgactagaaagctccccctagacaacctaacagtgagagggccagatggaagccatcctttttatgagcgagtcttaaaagtcacacggtgtggtgaatgcttcattccaagcaagtcactatgtttggcccacctcaagggtgaaggagggaactcggctccaccttctgaagggaagagtgtcgaagattttgtgggcgtattttagaacaccacatgggtgtttgaaatctgagctgtggatagggcctcccctctcaccctgtgtaggaattaatttcgggtacagcatccctgacagatggtcattcagccctctgcttgccacttccaactacgaggagttcactacactgtgagtcagtgaattccacttatatccagtgttaattgttagaagctttttctgttcatgaaattgaaagctctattgtggatattccattattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtgaaaacattctgattcagtttatccttccagaactgaaaacacactactaattctgtagcccgcgctaagtataaagggacacagcaagggtttcctcactttgcgtaatagtggaggactgaaaaatgactgtgaaacctgaaataatgcaaagtgatcctagtgggaaaaatgatgatcattctgagacctttataaactgcttttttttttttttttttttttttgagatggagtcttgcactgttgcctgggctggagtgcagtggcacgattgttgctcactgcaacctccacctcccgggttcacttcattcttctgcctcagcctcccaagtagctgggattacaggcacataccaccgcatggctaactttttgtatttttagtagagatggggtttcactatgttggccagactggtctcaaactcctgaccttgtgatccacccgcctcggcctcccaaagtgctgggattacaggcgtgagccaccgtgcctggacaaaacatctgtttttaaaactttaaaacttgttaaaattaaaaattttatttcaaatttaaatgcaaaaattagtaaaactagtgttcatttagtattcattagtattctgtaattaaaatattacatattacattaaagatatagagaatttaaaatacagaggattaaaatacttttgcaaaagaaaaaaaaacaaaaacatcaatagtagattgaacagtgcttgccaactccttcttcttgtataactaataatacagagtgagtatttttgcttcggcaaattgtcatcctgcttttaaaatttgtatcagctttcaacattatatcctttgagctttcagtattataaaacatctctgagagttcctttaatgtgaagttgtttttgctggtatcatttccttggagatacctttaatcactatccacatttatgttgacaagttcatctttgctaagttcctctggctgtagactttagagtctctgacagtggcagtgaccacattgctatggttagctgtataattacatttaggtccgattcccacctcgctactctgttgtcacttttcacttctttgctgtactttcatgtttcttgaccaattcactctcttcattatccattcttataaaatgccacatgggtttactgctgggaagcaaggaagcaacacagctacatgctttgatgtcaatgtgtgacctgaataatagatgcacagtgactagccacacatactttggaataaggagtgtggttggttactgatcatgatgcacgtctgttatgtatgtaatgatttgtggactacagaactagaaactaagtttgcactttattcaattactcacagttaatataccatggtaattgatatttgaaccatgttgttaggggactggtattatttaactaaatcatggtattggaaatttatgtacatcagattcatgcaaagcaaagtctgcctgtaggcttacgaattggtctggagttggaatcgatatttttttttttttttttttttgagatggagtttcactcttgttgcccaggctggagtgcaatggtgcaatctcggctcactgcaacctccacctcccgggttcaagcaattctcctgccctagcctcccgagtagctgggattacaggcatgtatcaccacgcctagctaatttttgtatttttagtagaggcagggtttcaccatgttggtcaggctggtctcgaactcctgacctcaggtgttctgcccgccttggcctcccaaagtgctgggattacaggcgtgagccaccgtacccagcctggaatcgatttttatgggcgactgttctgtgctgcttattttaagctcctggtcctcgctgtaatcaagtctcatatgtctttacctatgcatttgaattgtgtaaaatgtaagtgtaggattttacatacattccatttagcttgtggctgtatttttgacattttaaaaattttctgatacataatatttgtacatatatatggggtctctgcctttttaaagctggattgtgctatctagtaaacaaactgtcttctccaaattgttatccttttcacagtaagccattagcaagaacatggctggggccgagctcaatgatatgtttccagagttctctaagagctctccagccatacttccctcatcctattaatcaaccttttaagtaggaatatatagcagctatgaatttctccaactctgctgtcatccagcctgacgttttcgagcttgtccaacaaagttatctgtctggtgccatcagatgcctttctgaaatcaaagcatattgtatcagtagtggtgtcctgaaatgccactctggttaccctaccaaaaattaacactatgggtaataccttatgtttacagagaacttttacagttcactggagtgtttggcatatctctattttaaaatattttgtctatatagagttgaagggagatatggcagatatcattactttattttcaaaaatggtaaatcagagaggttaagggattggctcttgttcacagagctagtaaatagcagaatcttgatccttcagtaaatccagtgtgtttgaccatttcaaactatctcagatgaagtgactacaggcaagaaaaagggagtttctgcagtgttttcctgtcgatttattaggacagatcagtcttatgaccctcctcctatagggtctgtgctggtttcccagggctgctgtaatgaagtaccacaaacagggaggcttaaacaacagtaatttattgtcttagaattttgaagtccaagatcaaggaatcagcagagttggtttcttctgaggactttgagagaaggatctgttccaggcctgtcttctttgctcatagatggttgtcttccctctatgtctcttcaactcattttctttctatatgtgttcctgtgtccaaaaggacaccagtcatactgaattagggcctatcctaatgatttcattttaacttgattacctctgtaaagatgttatctctaaataaggtcacattctgaattactggcggggggggttaggactgtaacatattaaattggggtgggaggggaggttcaactcataccaggtcttcaaggcagatttcaagtttttttaaaaatggccatccgggcgcggtggctcacacctgtaatcccagcactttgggaggccaagaggagcggatcatgaggtcaggagtttgagaccagcctggtcaacatggtgaaaccccatctctactaaaaatacaaaaattttccaggcatggtggtgggtgcctgtaatcccagccactgaggaggctgaggcaagagaatcgcttgaacccgggaggcagaggttgcagtgagacaagactacgccactgcactccagcctgggcaacagagcaagagtccctctcaaaaaaaataaaaataacaaaggcccaaaggaataggcttgtgtagggagtacttttgtgtgtgcctgcatttttaaatcaatgtctgtgtatctgatacagtctattgagatcaactttatggtcaattgatactgcctttcagtttttcaaaagagagagagagtgagtgcttttcctaaattaattcttagttgtctacttgctgaatgtagtctctgaagatgtcttttgtgaggcagctgctgaaattatttgcttgtttgatgatttcaggattcaaatgtgtcatttaactttagagctgagatttatggtgaatttcactccgagcttggtgttaattttacacacatctaagcagtttccttcttccacaagttggttaagcatcagaggattctgaatttaggaaaaaaaaataaattaggcagtaacaatttgcatcccaaagtgattcacaagttttcaagtatattcaagggttgtttagcatattaccgactacttatcaaaacacgggactgattatgaccttgttttagattgctggtgttgaggtgctacaaatgtgagatctgtattattgtgtttcctcattgccttcgcttcttctgtggttttttccttttggtcactttgggtgttccacagattaccaatgtgtgcatttcacatgaaatagattttgattttttaaaaatagcatttattgtgagtagaaaatttggtttcactcatacatttttctggtgatctttgtgcattttacttatttttttgaagtgattcttctttttaattaactcattgggtaaagaaagtacagttctaatgtctatgtaaggtgtaatgaataaggatgtgatgaactgtggttatctttgaagctctatgtgttctcaatatccgttcccttcccttatcaccattatactaaattttatgcttatcatgtccttacttttacttatactttcacaattttttttgtgtgtgtcacttgttgcttaggctggagtgcagtggcgcgatcttggctcactgaaacctccacctcctgggttcaagcaattctctgcctcagcctccggagtaactgggattacaagcgcccgccaccatgcccagctaagttttgtatttttagtagagacggggtttcaccatcttggccaggcttgtcttgaacttctgacctcaggtgatccacccgccttggcctcccaaagtgctgggattacaggcgtgagccaccgcgcctggcctcactatcttttttcactttcttttttttcttttagtcagagtcttgctctgtcacctgggatggagcacagtggcgtgatggtagctcactgcaaccttgaactcccgggctcaagcaatcctcacatttcagcctcccaaagtgtgggattacaggtgtaagccactgcacccagcctatactttcactttttatatttgcgtttccaaataatatactgtttagtttttcagttaaaattttttatttttaattcattaaaaaatgattcaaaaagttacaagaatatacaaaataatgctgctatagacttcacccggattctcagtgctaatattttacaaaatttgcttcattattctctactctctctacatatataggtagacacacacatgcacgcacacacacacatttttctggactgagagtaagttatagacatgctgttggagtctaaatactttattttttttccctaaaaaataaggacactgccttacataatcatgaattattatctgggtcaggaaattaacataggtataattctaccacatgatctgtagacccattcaaactttgcccactggcccaataatgcccttggtggctatttcccctcctcttattcagaatccactccagaaccacaggctccatttatgtatcacattcctttagttgcctttcatctgtaatgggtctttagtgtttctttgtctttcatgctctggataattttcaagaatatagaagagtttctccttttttcaaactgtcccttaatttgggtttgtctgatgtttcctcatgattagattcaggtcgtgcatttttggcagggacatcggagaaatgatgctgtgctctcagtacatcatatcaggaggcacaggatgtggaattgtcccgttattggtgatgttaactttggtcactcggctgaggtggtgtgggccagctttctgcacttctctttgtaaaataaactttgtggggagatactttgataattatataaatatcctgtttctcaacaaattttcacccactagttttagtgttcattgatgatttttgcatgaatcatttttttatgatgatggatgccaaatgctcattttctaattgtgtaatttcttccacatatattagttggtattccactggaagaaagaactctccattctcactcatgtactcattcatttacttatcattgtggactcatggattcccatattattctttggattttaatttgttagtatttttatttattttgatgctcaaattggcccagatttacctagtgggagtttgtttagagtggcttctttgtccttttgactactttctgactatattctagcacttccttacttttggcacaaaattatgttctagattcatcttgtattttccttaccagagccctggaatgagccctggagtcacttggttctgttttgtggagaatggtatttagaaaccaagatctgagaactaggggtgctgattgcatctgggtttcattgtctctaggcctctcagcagataaagctagtatgtgtgtgcatgtaatgtatatgtatgtatgtaaatatatgtaaatatatattactcctatatgtaatcaatctcctgaccctggggactgtctcctcggctacagccttgcccattccacctgcctccttgacactgcacttctccaaccccagttcccctgaccctattagcattctcagccttgactgctcccttagccccaactacctctgcattcctggatccaccaggcccacctgctggggctatatgaatggaaggaaaaggaaaggaaaggcacaaagaaatagtttataaagaaaaaaagaaaaggaaaaggctgtttggtttttaaaatattacatgaaaaaatacataacgtagtgtctaatggccgttagcctgtaggcaactggggttcaaattcaggatttattacctgccagatgcgtaattttgggcaaggtacttaacatctctgtgcctcaattttatcctctgcaaaatggggctagtaatagtgcctcatagggttcttgtgaggtttaaacaagttaacacatgtaaagtatgtaggatggtgtttggcacataggaaatatattttaatctctttattattatcagacatcccatcattttagaatatgttgctttatatttctaataaaaatgtgttaaataccaatgatttattagtggtgtcttctacagagatcagaagagttattaaagttaccgtttttccttccatgagtattattttctttattcagatttgactgtctataccttataccactttgcaacataagcattacattaaattactattacaaatcttgaatctttgcacttatcttttaaaaatttaatttttagagaagttttaggttcacagcaaagttgagagaaaggttcagagctttcccatgtatcccctgccgggacacatgcacagccccctcattatcaatatcccccaccagaatgctacatttgcaacaactgataaacctacattgtcacatcattatcaaccaaagtccacagtttatactagggctcactcttggatttgtacattatgtggttttggacacttgtataatgatgtattgaccattatagtatcatagagagtgttttcactgtcctaaaattcttctgctctgcctattcatccttccccctccaacccttgacaactactgattttttattgtctccatagtttgccttttccagaatgtcatatagttgggatcatataatatgaagctctttcagatttgtgtctttcacttagtaatatgcatgtaagattctctatgtattttcgtggcttaatagctcatttatttttattactgaataatattccgttttctggatgtaccgcagtttatttatccattcttctactgaaggacatcttggttgcttcctaaaggtacatccttcatctatcaaggagtgtttgttttctactacagaatgatacttgtaagccaccagagtctgtactctgatcaaataccaagggcatttgatcagtccctgacgttaaagaaaaatgttaaatgttatttccatttggaagctaatcataaataaatataaagtttcagagaaatgctagtgaaagccactgggatggttttcaagttatataattttaatttacatgcatctttttaggagttcatatcagagcttggcaactataggccacaggccaaatccagctccctgactgagttatatggcctgtgagctaagtatggttttaaaatgattgaaaaaaagtgaagaagaagaggaagaagaagaagattttataacaaatgaaaattacataaaatgcaagtttcagttcctgtaaataaacttatattggaatatagccatagccatttgctactatattgtctatggttgattttgcaattcagcgacagatttaagtagttcaatagacacaatatggcccgcaaagcctaaaatatttactgtctcaccctttagggaaactgtgctgatccttggtttatactattacagaagcaatcataaagttttggaagaatctcggaagacatgtctagtttaggagatatggcttcccctgcaccttaggcatttaaaataacctggcctgtttctttctgaaatgagaatattggatctgaagatctaagtccctcatgcctcatgctattctttgatgcctttgtaacattattcgccccattgtactagtccgacggggttttttcccccactttggtttttattttaaggcaatctcacttcatctctcttttccattaatctgtttgacatgaactgagctaatacggcaatttttgtctctgttcaaaaacttcaagaaattttgagacctcatatttttatctggttttatttcccctcacagtgacgtaagagtggattttgtataatagattgaaatatgttcttttattttgttggatggctgagctatttcacagtggctcaaagagcagtttactttgttccatagcaacaagcctcttgcccaaatttgccatctggtgtttgaagcctgtatcttgcagcagtttttttcattagctgacagccattactcatctgcttttggctttagtattcccgacattctcattattgctcatcctaaatagtcccagtttcaagtaagaaagcacttggagttgtttgcttagcagaagggaatcaatttcatctggaaaacaaggggccagttgagaagatacctgccagctgggaccatgactttattatttgtgaaacttggtttttaatgacttgtgtatatgcttaacagcccacctagagtgtggcctgtgaaggggaagaccaattggccatggtgggtacccactagatggtgaatgagtgaacgggtttcctgcataaatccaggaaaccttgggatgaaaaagcagtagccccatgaagaaagcatcaatcatactttgtaattttgccacatttgctttccaaattttttttagagattacctgaaaataaatctcagggctgatccctggctacctctgatctgatcttctatcagtctttcttgtagtccttgtactgtatccccactagcctctctggtgtttcagaacctgccaagcacactcccattttggggtccttgctagatattccctctgcctggaatgctcttccccaaatgtctaagtggttcactctctccttttatgcaagtctctgcttaaacctcattcttcagagaaaccatcacactccacattttagtctatttacctctctttattttcaccataaccctcactatgaagtatatcttcatcaatttattgttcccagtctctggaataatcctgagcatacaggaagcactcaggaagtactttctgagtgaaaacatgaacaaaagcaagacaaaaatctattaaatacttgatttgtgaattaaggttttccccaacccaacacttccgtgttatttacagaatactcctgtctatttcacatcttgtagctttttgcctctttgctgctcctgttgttaccccttccatcccttttcccacaaccctggatacttaccaagtaccaagtcctaccaaccactgtccaagttctgccttttctttgaaatcttcgctgatcacacttattatctctccattggaacccacagggccattgcacttcctcatcctcccttctcatgtctaattcattttctacctctgcctgtcttaactcctaaaccttaagctctatgagtagagactatgcatatatattcctatttttcatactttgcattttcatatacacttaatgcatatttttagtacattggctagaataagacatttattattaacaactttgtatctaaaaaggagtaaagatgaaagtggagtcactctcaacttctttcctaaagagataagcactgtcattatttagacacctgctatggtttgaatgtttgtcctctcagaaactcatgttgaaactcaattgccattgtaatactattaagaggtggggcctttcagaagtgattaggccgtgaggacagagctctcataaatggattaatcttgttaccatagtagtggttatcttgacagtgagttgttataaaatgactctggcctcgagtgcttccctctttcacatgctcttgcctgcccttccacctttctgctgtatgatgactctggctagatgctggtgccatgctcttggaattcctagcctccaaaacggtgagccaaacccattttgctctttatacattaccaatctgtggtattctgttgtagcaggagaaaatgtactaagacagaaaattggtaccaacaccagggttgttggaataatagatacctgaaaatatgcaagtggctttggaactgggcaatgagtaaaggctggaagaatttggagaagcaggctagaaaaagcctagattgctgtaaatggagcattgaaagtgattctggtgaaggctcagaagaagagaagactggggaaagttttgaacttcttaaagattacctaagtggtcatgaccagaatgttgatagaaatatggacagtaaaggctgttctgatgagatctcagatggaactgagaaacaaggtattggaaactggggcaaaggccatccttgttataaagtagcaaagaacttggctgaaatgtgtctataactgagggctttgtgaaaggtggaatttaaaagtgatgaaataggatatctagctgaagacatatttaagcagcaaagcattcaggctgatgcatggttacttttaaccgcttatagtaagatgctagaggaaaggaatgatttaaagatggaatttataatgaaaaaggaagctatgtgaaaagatttggaaaatttgcagcctggccatgtaaacaacaaaaaagcattctagtgtggaaccaagagaccatttactgacgagattaacacagacagaagagagccaccatcaatacaatgggagatagaccctgaaagcatttcagagatctttgaggctgccctgctcatcacaggcccagagttctaagagggcagaatagtttgaggggttgggctaggagcaacctacacaggctccctgcccagaccgacctcacatctctgcttcctgcattccagcagagagctctttcactgctcccaccatggctcaagcaggtccatgtgtggctcaggccacaacttcagaagatgcaagtggcaaatcttggttgcatccatgtggtgttaagtttgcaggcatgcagaatgcaagatctatgggggcatggcttcatccacctagatttcaaagtatgttgcaaatagcctggagccccaggcagagacttgtcacagaagcagagccactgcagagagccccaactatggcaatactgcacaaaaatgtggggttggggttagtgccagagctgccacagagagtcctcactggggtaatgcctagtggagccctgggagcaggactggcactgagactccaggatcgtggagctactagcatgcaacctcagcctgggagagcagcaggcaggagactccaacctatgaagcatgggctgggtctaggaaagccataggagtggggctgccgaagacctgtgtgcccaggatgcagaaaatggagtcaaagattattctctaaattgagggcttaaagtgttttttcccattgggttttggacttaattggagtctgttactcttctctttttgcctatttttcccttttggtccaggactgtcaatcctatgcttgccccaccattgtattctggaagtagataacttatttgatttcacaggctcacagctgtaggaatatgcctatggatgaatcctgtctggtgtctcacccacatctgatacagaggagactctagacttttttttttttttttttttttttttttttggagacagggtttcactttgtcacacaggctggaactacagtggtgtgatgacagcttactgcagccttgacctcccaggcttaagtgatcctcccaccttagcctcctgaatagctggggttacaggcatgcatccccatacctggctaatttttttgatttttttagtagagatggggtcttgctatgctactggtctcaaactcctgggcgcaattgatcctcccacctcagcctcccaaagtgctgggattacaggcgtaagccaccacgcctgacctgagactctggacttttgaattgatgctggaacaaccacttaagacttttgggactactggaatgagatgaatctattttaggccaaatacagtggctcatgcctgtaattctagcactttgggaagccaaggcaggaagatcagttgagctcaggagttcgataccagcctgggcaacgtggtgaaaccccttctctaccaaaaatacaaaagttagccaggcgtggtggcacatacctgtggtcccagctactctggagacttagatgggaggatcatttgagcctgggaggtggaagttgcactgagccaaaatcatgcccactgcactccagcctgggtgacagagtaagaccccatctgaaaacaaaacaaaaaaaagaaatgaatatgttttgtacttgaaaaggacatgagttttgtaggaccagggcagaatgctatggtttgaatgtttgttttctctgaaactcatgttaatatttaattgccattgtaacagtattaagaggtagggcctttaaaaagtgactgggtcatagggatgaagctctaatcagtggattaatgccattatgaagggagtgggttagttattgtgagagtaggttgttaatgttttctttccttttcttgtttttttgtttgtttgtttttgttttgtttgagacaaagtctctgctgtgttgtgcaggctggagtgcagtggcatgatcttggctcactgcaacctccgcctcccaggtcaagcaattctcctgcctcagcctcccaagtagctgggactacaggcacctgccaccacgcctggctaatttttgtatttttagtagagatggggtttcaccatgttggccaggctggtctcgaattcctgacctcaagcaatctgctcgccttggcctcccaaagtgctgggattacaggcatgagccacttcaccccgccatgttttcttttctctagcttactttagtgaagaatacagtatataatacatataatatagaaaatatgtgttagttaactttatgttgattatgtcgattatgttattggtaagtctttggccaacagtaggctattagtagttaagtttctgggaagtcaaaagttatcgctcattttagactacggtgctcctaacccctgcattattcaaggggcaactgtaatccccttttcttcttgaattactaattctattctacttccctcacagactttttactaatgcaatatatttttatacttgaaagccttctgttgatcaaccattgtagtaaaatatctgtacatagatttaagcatttacagtggcccgggaatataagaaaattaaaaaaaaaaattgtattacacgttttgaaagtaatttgttaagtgtaaaaagtttttttcatccagtttgataatatatctatgaatgattgttagttgttggtagaataaaataaggggcagcatcaattttttcttattttccatttttatagatgtgagttttaggaataattttaacataaatcgagtagatgcgaatggaaaaagtttcattgtagcaatatcattcaattctttgaacttgttatgtgataaatttacatattaatcaatcaaaaatatctttaatgatctgtcaattgataagcaatgaggacttctatcattttattgacagttaaagaccacaatgctagagaaatatcgtagggtgccaggcagaagccttggtaggggcacatttgagcttggtgactatggctattccatctactgtgctgcgtgccttgttccagtactgcatggctactcaggtgcagcccagaaaaagggaaagtgggactcagttatttttaccagctgtatgttaagtaaaagacaatggaaatatgaaataatagatagtgaaatctaacctcgacaaggaaaatggaggaagaagatggctggtggactgggcaaaagtacagggagaaagtaaagggaaggctcttttttttttttttttgagacggagtcttgctcttttgcccaggccagactgcagtggtgctatcttggctcactgcaagctccgcctcccgggttcacgccattctcctgcctcagcctctggagtagcttgattcttttcgcttttgttgcccaggctggagtgcaatggcgcaatctcggctcactgcaacctccacctcctgggttcaagtgattcttttgcctcagcctcccagatagctgggattacaggtgtccaccaccacacccagctgattttttgtattttttagtagagatggggtttcaccatgttgaccaggctggccttgaactcctaacctcaggtgatccacccacctcggcctcccaaagtgctgggatgacaggcatgagccaccatgcctagccatgtttctttcctcttgctgcttttaggattctttctttatccttgatctttgagagtttgattactaaatgccttgaggtactcttctttcgattaagtgtgcttggtattctgttaccttcttgtacttggatattggtatctttctctaggtttggaatgttctttattatccctttgaataaactttccatccctatctcttttcctacctcctctttagaagcaaatctatgagttattgaatttgtgggtttttagatcctataggcttgcttcattgttttttattctttttatttttgtctcctctgactgtgtattttcaaatagccttttttttttttttttttttttttttttgagaacgagtctcactctgttgcccaggctggagtgcagtgtcgcgatctcggctcactgcaacttctgcctcccgggttcaaacaactctctgctcagcctcctgagtagctgggattacaggtgcccaccaccacgcccagctaatttttgtagttttagtagagacgggttttcaccaagttggccaggctggtcttgaactcctgacctcgtgattcacctgcctcggcctcccaaagtgctgggattacaggcatgagccactgtgcctggcctcaaatagcctattttcaagctcacaaattttttcttctgcttgatcaattctactattaaaacactctgggccgggcacattgcctcacacctgtaatcccagcactttgggaagccaaggcaggcagatcactaggtcaggagatcgagaccatcctggccaacattgtgaaaccccgtctctactaaaaatacaaaaattagctgggtgtggtggtgcaggcttgttatctcagctactcaggaggctgaggcacaggaatcacttgaacccacgaggtggaggttgcagtgagccgagatggtgccactgcactgtagcctggtgacagagtgagactccttctcaaaacaacaacaacaacaacaacaacaaacaacagtctgatgcattcttcattatgccaattgtatttttcagcttcaggatttttccttgattctttttaattatttcaatctctgttaaatttgtctgatagaattctgaattatttctctgtgttatcttgagtttctttgagtttcctcaaaacaagtattttaaagtctctttctgaaagattacatatctttctctctcctggattaatccctggtactttatttagttcatttggttaggtcattttttttttcctggaatgtcttgatacttgtagatgtttgtgcctgggcattgaagagttaggtatttattatacttgtcactatctgggcttgtttgtacctgtctttcttgggaaggctttccaggtatttgaaaggactttggtgttgtgatctaagctatatctgctttagggggcaccccaagcccagtaatagtgtggttcttgcagactcgtaaaggtagtgccttgatggtcctgaacaagatctggaagaattctctggtttaccaggcaaaaagactcttgttctcttcccttactatctcccaaacagtctctctctctgttcttaaccacctgaagctcggggtagagtgacacaagcacccttgtggccacaatcacccttatggccacaatcactatgactgtgctgggtcagacttgaagccagcacagcactgggtgttgtccacagctttctgtaatcactccctggctactgtctatgttcactcaaggccctggggctctacaatcagcaggtggtgaagccagccaggcttgtatccttcccttcaggatagtaagtcaccgcagttccctggcagttctagaggtgccgtcagggagctagcgattagagtcgaaagacttagaaagccacctggtgttctattgtactgtggctgggctgaactcaaaccacaagatacagtccttcccactcttccttcccctttttgaaggtggaggagccttaccttgtgtccactgccaccacaggtcccctggaagtcctgccagactactgcctatgttcccttaaagcccaaggattcttagtcaacttgtgaattctgcctggcctgggataaactcttcagagcagtgggcttccctttggcccagggcagatccataaatgctgtgtaagagccaagttctggaactggggactccaggagcctgcttgatgttttattcttctgtggccgaactggtacctaaagtgtaagacaaagtaccgtttaccctctgctttcctcaagcagaaggagtcttgccccatagccaccacagcttgggtgaatgtgctgagtttcacccaaggccctcaacatagtacctggtattgctgctggttattcagggcccaagggctcttcagttagcaggtgacgaatcctaccaggactgagtcttttccttcaaggcatcaggttcccttttggcccaaaatatgtctagaaatgctgtcaaggagctagggcctggaaagacagtctcacacccctgacaggtgccctatcctgctgtggctgacccggtatccaagatgcaagaaaaagtcctccccacccttccctctcctctcctcgagtggaaggaaggagtctcttttggagccatgagctgtgtggcctggagttaggggaggggtgatgccagcactcctgcagccaccccaatttgtgtctcaggaggttgtgttcccccccttcccggcccagtctattgtctctgggcccagttcagcactaggactcacacaaaagttgtagtccttgggacctagactggcttttaagtttattagggcctctgggcactttagcccactgtagtctgtggctaggcttgtggaaactcaagtcccaactgctgggatcagcaattcccctctggccaaggctggtttgaatgttccctctgtgggcagacatcagctaagtttggtccagttttctttctgctataacagaacagcactgagttcggtggctcataattgctatgctctccttccaccagtgcccagaaatgctctccacaccacatcaccacgccctggggggtagggaaggggtagcatatgcaattcaagactggtttttgtatctcttcagtgcctctttcagcaagataaagttaaaaccaagtaccatgactgctcacctgatttgtagttcttatgaaggtgctttttaatatagttgtcaaattggtgtccttgcagggggtgattggtgaagccttctattctgccatcttgctccgcctctccaattagccatttttaataccttgtatcttcaattgagaatttttgaagtctcagattgatattatggcagaaaaggaggaatcacacacagcttgtctttggatgaccaaaagcaaacacctgtcttttttttttttttttttgcctctaaactcaattccatttggtatcaaataccttttaactcagctatagtctcttttaagaatatttacatatttaataaaaaacaaatgactgtgactcactaatatgtgtttcttttcttttctttctttcttttaaagatagtgtttttagaagaagcatctcaacaggaaaaactggccaaagaatggtgcttcaagccgtgtgaaataagagaactgagccaccagtaagttgttacttcttcccttttactgggtgccactaataagcttaaattatagaaaacctgccttgagagacagagagactttaaaaaataatattaatttaacaataattattttgtattaattatttgttaagggaggagatgggaaggagaaggtatacaggaagctgaaggatggaaacttagagagctagaggctgccatcattcatcaatttctttagcatatatttgttgagcatgctatgtgcagtactggagggtctggaggtgaaaaagatcttcaaagtccttgtcctcacagggtttacagtccatggaggacaaagacagtaaacaagcaaacagatacctgcgcatgaccatagtagattgtgatagcttctataaggaaggaaacaaggtggggaggggtatgatagaggttaactattaagaagtagggaggaaagaaaatttgagaatcaattggttggggaagttcagaagcacacttgagctgtgatattatatttcatctacttttagtggtttttaatattcgttatatttcatatataatatatatttaatatatgttatacagttcttaaagaaatgattgggccagccaggcatggtgtctcatacctgtaatcctagcactttgggaggccgaggcgggtggatcacctgagatcaggagttcaagaccagcctggccaacgtggtgaaaccccgtctctactaaaaatacaaaaattagcctggcatggtggcgcatatgatgcctgtaatcccagctacctgggtggctgaggcaggagaatctcttgaagcccggggggcagaggttgcagtgagccaagatcatgccacttcactctagcctgggtgaaagagcaagactctgttaaaaaaaaaaaaaaaaagctcagtttcctcatagcctggttgatatgctttatggaaatgggaaaactttttttgattataatttttattttattttttgtttattttactttaagttctgggatacatgtgcagaacgtgcaggtttgttacacaggtatacatgtgccatggtggtttgctgcacctatcaacccgtcatctaggttttaagccccacatgcattagatatttgtcctaatgctctccctccccttgccccccaccccccaacagaccccggtgtgtgatgttcccttccctgtgtccatttgttattattgttcaactcccacttacgaatgagaacatgcggtgtttggttttctgttcctgtgttagtttgctgaaagtcatggcttctggcatcatctatgtccctgcaaaggacatgaatgggaagacttttttaaagctaaaatattttatcttgtttcaggccaagtaagttccaaggccaataaaattggtaccatttatattctgaaaacactttgataacttgggaattgactttcacgtaatatagagaaacactgtttcacgtaatagaggaacattgaactaggaatgaaaatacctggtttgaatccacagactgtactgtagctttgcagatgttaaaagtcaagcaagccactttccctctttgaggtcatctagactatgaagctcatccctggtcatagtccagagagacagagtgactatttataatgtttcactccacctgcagttttactcacatcccttgcctccttccctctccctgctgcctctctatgggcttggaagtgtgtgggcgctgggcatggaaatgaatatagtagcttctgctgttaccatctacttcctcttgctagattttcatgtaagaatctatgatgaggagcaactgacatttatagtctcctgcttgcgtgtctttgtgatgcaggattagaagaaggcttggaagcagttgaagtagaggctgagatgggatgagagaatggtggaaacggttggaggatggagaggagggtaaacataactgtgggtcttcacttccttttcttcctctttatgaggttgcttttgaaattaaatccatcagaaatgcagattctgggggtcgtatgtaagtactgcacacaaggaagtagtaaggtaagaaataatttaaattttagtagaagactgaagtctttgaagaaagattatatttaaaatgcagagattcttatatcaagcacacaagttatgtgcggttgaatttaagtcatgattaaaataccataaagggatgtctcagacagtttttaatagacttggcccaatacacagtgtatctacaggtctatctcagtactgtctggatttttagaaaagggaaatcacaactggagtaccatgggcagtgctgtggtaggagtgaatcagatggtggccatggaccctggacaggtttgcagggccaggattagggtgaggggagtgaggcattcacctcaggcacaaaatttaaaagcagcgggggaggggcaaaaactcagtaatcaagataaatacttttaagacaatattttaaaatataaaaagtaatgcatggctgggcgcggtggctcaccctgtaatcccagcactttgggaggccgaggcaggcggatcacttgaggtcaggagttcaagaccagcctggccaacatggtgaaacctgtctctactaaaaatacaaaaattagccaggtgtgggccgggtgcggtggctcacacctgtaatcccagcactttgggaggccgaggcaggcgcatcacgaggtcaggagatcgagactgtcctggctaacacggtgaaaccccatctctactaaaaatacaaaacattagccgggcatggtggtgggcccctgtagtcccagctactcgggaggctgatgcaggagaatggcttgaacctgggaggcagaggttgcagtgagccgagatcgcaccactgcactacagcctgagtgagactccatctcaaaaaaaaaaaaaaaattaatgcaaaaactcatgatgaacaaaataccaacattttaaataaagacaagatgttgtttgttttacagccatgcattttttttgtgcaatggaacagtcactttcaaataacatggattctcaggcccatgatgccattgcattactggtagggcaggctgatgatggtgatgatggtttgggtaatacacacatgtattgatatatacctgtattgttttctgattataaaactttattaatgtgttccatttggtgaaaagataggtggatgttctgataagcatatatagggggatatatatatatataaaattttttttgctcaggttatgatacagcttggccaacactgcagatttggaatacctgggggaagttgagattctctgaggaaattatgatgctgattaagtaaagtgagaagaggaaagctgaaaagaagggagaaaggagagcttttttaccttctgctgctgccttcagatctcttctctgctttgcctgcagctgggcttgtagtagctacaatttagccataagtgatgttgtgagtggagaaccgagtttgaatcctagctgagccaccaacaaattgcaagtcaaaaataaacttgcaatcccagaccttccttttgttctctctataaaatgagcaggtgggctcactgacctctaatctcatgtgcactctcacattccatgcttctgtgtgtaccaatattatctgtaattaatcctggactgtaaccttgattctgggaatctttttattaataatcatttcacgatgcttactatttccttaaaaggattgtaacttttctgggtaaaaaaatcacacttcagatgcaataaatccttgcgcttctgttgcctctgaagactttgtactctgaatcatctttcactctctcatctcagctacaatgaacatgctcatttctcctacatgaaaaacataaagtgacttgaactcttcttcatcctaactttcactaccaaatattttaaaagggcgctctccatctgcacaggactttctcaaacactctctttttagcacttagtgcagtaacaaaaacattctagagactcagtgactactttttaaaggaagagctaaatctttccaaaattgggggtcttaggattattcctgaggccatgcatttttgacccttgcagtttttggcactagtcactgccctgctccttcttgaatgtctcttctttactgtccctgacacctctctgtcctgggttccctctaccctcctgacaataactctgccaagattgatcctgatcttttctttctcagtcttactcctgaagtcgaaggtgctgcttaagatgttggtttgttcttccttccacagagaactctggcatcgccaacttctagagttacctatataagaccctcaaatctgaatcctttctttttttttttttttttttttgagatggagtctcgctctgtcacccaggctggagtgcagtggcatgatctctgctcacctcaagctccgcctcccgtgttcacgccattctcctgcctcagccgcccgagtagctgggactacaggcgcctgccaccacgcctggctaatttttgtatttttagtagagatggggtttcaccgtgttagccaggatggtctcgatctcctgacctcgtgatctgcccgccttggcctcccaaagtgctgggattacaggcgtgagccaccgtgcccagcctcctctccttcttttcttctgcctcttctcccttctccttcttcttccttttcttgctcttcttcttccctcctcctcttcctcctcctcctctttttctccttctcctcctcctttctcgtccttttcctcttctcctcctctcctttttctttctcctcatttttcttcctcctcctctctgtctccctcattcacccgtaacctcctcaactagattataaagtctttgacgacaatatgccttatttttctctggactctccacagggcttggcggtttcctaaatatagtagacattgggaaatattatttggttaaacaatttaactgcatgaggaagttacactgctattccgttttatgacgggagagaaagcaaagacccaaaggactgacattgtagagagatcagtgactgatacctgagagaaatccatattccaccctccctttcagagtgcttcccacattataggcccacttaatgctgccttcttgacgtccttaaaaatttgtcacagttctttatttccatagtcagtgaattaacaattccatcacgtggaacgtagtgaccgagagtactgaacctacagacaaactgcctgggtttgaatctcagcgccaaagctgactagttaacagttactttttttcaagctacataaattccctgagctttagcttacccttatgtaaaggagggtaacagtactctcatacttactaagtttcttgtgaacattacatcatcatcatcatcatccataacatttattgatgctttccattatctaggcattgttcttacacacactaaatacatcctcatgacagccctatgatgctactactatctccattttacataaggggaaactgagtcacacagaatttttttttttttttaatatgtcaaatatctaactgctgatttatggtcaaacctgatttcagatcttagcaggccaaaaccagaatgtatacactttaactcaactgctgcccacagatgagatgatgtatgtagaacgctgtgccagtgcctagtgaatgtacatattcaggaaacattagctgctgtcaccatcattattataataactgactacaaaaaagctagtcttttccatgcgatgtagaggctttcttgtagtcagacaagatcaagatgaccactgagtctgccattccttgctcttgttttaaaataaagcatttagagttactcatggctttatttggcttacagttaggtggtatgtatacatttgatttgatagcatgaggaattatttgtaatgttaggtttcaagttcaagttgcttatgtgattgaatacttacctaggataatggtggcagtagagggtcccatcttttggcaaatatctgtttggatgaggttggatacttaatagtgactgtggtgaactgcattagctctttagaaaagcatgaagtgtctgttagcaccatactgcctcaattctgtgggtagtgcctctgaacactttccaggactttctaattataagaattaatagaaatatgaatattaattggtggatcatggtggtagcattagtgatcacaagcatcctgagcatggttgtcacagcatcatatgtaactccctcttcgcttcactacttacaccactgcccgtttgtggtccatctcctgagatcgcctgtccctaaccagcttgctcttgctgcttctatttcagaactcagtttctgtaacacgtgggaaaagactaggtttcttgtagtcagacaagatcaagatgactgctgagtctaaaattgcagccagtctgtttctcacctttagttgcccttagtgactggtgtgcacattgctcagcacggctctagaagttttaaaggcctcctcttccattcttgatctctgacctacaactatcagttgtgagaacaaagtcatgggattaaatcagagttcccgtcctttcttgtgccaccactgctttgcttctgctcaatgctgtgtttttccctcccttcgtcatcactggttaaccccgaccagccattccaacctagaagctatatctctcctagcagagcttcatttttatgtcctgacctctaaataattggagaatttacagttgtctgattgcattacctataaacctgtgtgggtgaacagtgaaatcatgcttgggaaaaaatgtgatttaaaaatatgggaaatgactgaagatattattaaatacttttattctcatcttaatttccagtgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcgtaagtatcttgtgtgtgagtgtggtattctgtttggtcatctatagaaatatcagtttcctaggacagatttaaattataaagcataagcagttaagcctaagatgggccatagagaatttttaagtttctttttcacagtccagtgagtttgtgaccacctcacctacacagctagtcagtggcaaagagagaatttgaatccaagtttccaaaaccccaatctggtgggtttacgttactcttttactttctgtgttttactttaccaaatctgggtttaatgaatatgtgtatttccctactcctgctaatccataatgctgttctgaggaccatatggattcattatgtgacctttgcaaagttatgtgactcacttttcccatctgtaaaaaatagagatcatgatagtacctatttcacaggattctcatgataattaagcaagttaatatttgtgaagttcttagaatagtgcctagcacatggtgggagctctatttgtttgctttaaaaatgcccaaggaaatttaaaattaaatatttaaattactgttagaaggaatatcatgttattctgggagctttgcaaggaaggaaaataggatggtcccatattgcatggcacgtggtaatgtgacttgagcactgacaccactagagggaactctggggctagtacagtcattgaacagtggcagtagtgtgtaccagccatatgttgaaggctctgaaagtgtccttccttctcctctttcaggaaaatcagttcctttcttactccaatcctgtgcccagaaccagaatctactcaggaattagaaacagtttctgcagtaaaggagctaaagcgcaaatgctgccttgtctgatcattatgtcctggtgttcagcgcacttggtctgaacactcatggatttttgtgggacccattgattcctcctaaggtgttcactacatgtggtggtggcagtattataagccttccacatcaactgacctaaccatcttgccagtttttttggtcttgcatcattccagtcttagagagtaaaagcaagtgctttttttttttcttcttttttttggagacagagtctcactttgtcacccaagctggagtgcagtggcatgatctcggctcactgcaacctctgctgcccagattcaagtgattctcctgcctcagcctcccaagtagctgagattacaggcacctgccaccacacccagctaatttttctatttttagtagagacggggtttcaccatattgctcaggctggtcttgaactcctgacctcatgatccacccacctcggcctcccaaagtgtcaggattacaggcatgagccaccgcgcccggccgagcaagtgctaacatttatacacttgcctcacgtaattataaattcagtgcaattgtggatcttacatatttagcatgcaccacatgacactagaaaagctgagaaggactaaagctatgtataaagtagctggtgcattgtgttaatgaatggtgttaaccacaccaaatctttattctcaaaatttatttatgcctcacattgttctaaaaaagatgtgagatagctgaaaattgcgtagtatacaacaaaagaaaatgagtcatgatatcaaggcaaagaaaaaaaagggggaaggaaaagtaaaataaaaccaagaaaacaatgtctactgtgggggtccatgcatttgttagtttgtcatgaatttggctttagatttctagaacctgacccaaagagggaaatcagttctgaaatttacactgcttttatgattaaaaaacacatttgttaaggtaaagcatatctatgcttcatactgaaacttaagaaaattaatctcaatattccttagtgtggatagacactatgctgccaaaatatatattgtaaagattctatactatcaagaagtccagatagatcattcttttatgtttagagaggtagagtatcaaagactatatatttttcaggcagtactccatataaattatttctgacatcagagatttgtttaagtatttgatgtcaggccgagtgtgatggtggtttaagtatttgatgtcaggcctgtaatcctagcactttgggagaccaaggtgggtggatcacctgaagtcaggagtttgagaccagcctggccaacatggcaaaaccctgtctctactaaaaatacaaaaattagctgggtgtggtggcatgtgcctgtaatctcagctactcaggaggctgaggcatgagaatcgcctgaacccggaggaggaggttgtagtgagccaagatcaggccactacactctagcctgggtgacagagtgagactctgtctcaaaaaaaaaaaaaaaaaaaaaattgcggagcacatatcctatgttctttcttatgtgtctgataatgaatgagtgtgggcccacaaacttttaagttggaggcactgagggtatggctgacatctgtttaagggtgtggagatgtgttaactagccacgtagcctactcagtgggatgagctcagtgggaataaacagtagtagctttgggtttccttcctcccttccttcttccctttctcaggggtctccctgtcctgtccctttactgtaattagggcacttcctgaactttctagtgttttcagttcattctagttgtggaaagaaaaacttcacacaaattaaatttaacagagtaaattgagcaaagaacgattccagaatcaggcagctctcagaaccaggaaaggttcagaggactctgcccagcaaggtgggcaggcagcatttaagacagaaaatggaagtgaggtatagcaacagcttgattgttacagctctgggtttgccttattcaaacttgttctaatcacttggcacctgtgactggctagagctcagctgctgtgattggctgagactcagctatttgttacaaaagcatattactaatcaggctttcagtgagttgataaactaagttaggttgcagttccttataaactcaaagttgagaagcatgctcaggccaaatttagcttgctttaacacagtccaatttgaagtttcaatttctcattcactaaaatcttctcccatataagccctgtacctcctggtttgggcctgacactgaggaaggggcttactatcagtgtttgtgtagtgcttctaaataaccccagctttccgtttcaatttcatctttaagtcaagattgtagaaaggtgcttaaaattttgaaaatttagaaaaatttagattacatatccgttttaattttgagttttattttagtttggttagtaaatgtaatgtgtcatttttcttggggatagctgagatttatgacctaataaaaggttaatttttatgattattctgcgattttttaaaagaagactgcattttctctgttgatttgacatttttttctatctctatgagatgaagttgttaaaagtcttgaacacttctattcttttgctgcatattctcccatatggtaagacaagaacattttcattctgttcccttcttcatccctaccttttttgctacgtcctatgttatatcatctgagattttagttccatttttttttgccgtgtatactatatttaagataatatttaacttttaagtttaatttaaaaaaattatctcaatttaattccagttttttattttaacatctgcacttaatttaacaatgagggccgggcacggtggctcatgcctgtaatcccagcactttgagaggcctaggcggacggatcacctgaggtcaggagttcaagaccagcctggccaacatggtgagaccccgcctctactaaaaatacaaaaattagccaggcatggtggcgggtgcctgtaatcccagctactcaggaggctgaggtgggagaatctcttgaacccaggaggtggaggttgcagtgagccaaggtgcaccattgcactctagtctgggtgacagagtgagactccatctcaataataataattattataattataatttaacaatgagctttgctttttattttgctacttggatccctgtcttcattcatttttgttggaatatatcctctgacaattctttccaatcaggtgagtgataaacattctaaaacctagaattatcaaaaatggctttactttttttttttgactcttgaacaatgccttagctgtagagagaattctatttgaaattatttatctatcagcatccaatgtgctgacatcaatgtgattctcatttctttctagttaattttctggcctttgagatttttttcttcattcctgatattctgaaattgtaattgttgatcatcccaattcattctcagtttaattcttcaattcattctctttaatacatagttctttcaataagagaacttctgtcttccttctgtttctaggaattctgttatttctctttctctttctctctctttctgagtatattcctctcttcaatctattcttccttttgataattactattagaaaaatattgaaacttctgttctgttttcatgtctctaaacttttctttcacactacattcttaggaaatggtatgggccagttttgtaaatcattaactcactcttactatttataataacctgttcctctttcaagatatgacatcctgtcctattcatcaaaggatgctatttttcattcattttatgtctcttgttgttttagtaattctgcttcctcaggtgttcattcagtaaatatttactgagcacatcctagaacccatacacttttctagttgctggagattaaatttgatacctttgtcatggtattggctttccacctggatttgtgatggagagctcatccttgtctgtaattgacaggttctaaacatcctctgctggtggccagatctttttgttttacatgaaaattatcttaatatttggaaaaattgacaggtttccaaattcttttgacttttggggctaaccaatattactgagttctcatttgcttttttgaaacaattgactgggccaggtgtggtggctcatgcctataatcccaacaactttgggagtctgagggcaagaggatcacttggggccatgagttcaagaccagcctgggcaacatagcaagggcttgtcttaaaaaaaaaatagctaggcatggtggcatgcatctgtagtccctgctacttgggaggctgaggtggaaggctctcttgatccctagaattcaaggttacagtgagctgtgatgtgtgatggcacctctgcactccagagcaagaccctgtctcaaaaaacaaaacccaaaataacaacaacaacaaaaaatggaacacactggatctaattagaggctactgtctaaggtacggcatgttcatttctattatcctaactccaaactatttcaatcctgcagacacttgagcttctgatgtctgtactagtcaagaaaaccctgttttttcacaaaggaggaaacatggaatgtaagcaaccttctcaaggtcacgtagctaataacaggcaaaacgtaagcaagagccactgtctggagggttttcctctgcatttaaaagcttctgctaaagatatgccccaaagtattcaatccactagtcctttttccaagtgctcagacaggtcaggcaatatccgttccattttctttcttgaagatcttctcacctcctcccattctcttgtttctggtcagcattctctgtagcactactgtaatcttggcattctctttgcctctttcctgcgtttaatgcccactccctggatccaggaattactttggattactcttgtgttttactaaaagacagtttctaaaagcttcctaagaaagagttcatggagagtaaaattttcaagtccttcggtacttaatcatatttctatgctaccttcacacttgattgataatttaccaaggtataaaattatatgttaaaaataactcctgttgtgacaaacaacttatatgtacttgtgggaagacctcctttttaattgctagaacatgagcattgcattttttgcaagtacttaattgtctgtgtatcactgtggcccttagaaaattttctaaagtacttagaaaatagaaacctatataatagagcgttttctattttctaagtactttaattatttacttaggatttttggttacagaatgatatatatgagttgaatttgaaggcattgttctgcttccagcattgttagtgagaaatccaatgtcgttgtgagtcctgtcatttatctgtgaccagtttttttttttttcctggagtttttagcatcttttctgtacttacgaacttaatatctcacaattatatgccttactttgggttctctttttattccctgtgctgacaattctatgaggattttaattttggagatgaatattatttttcatatttttgtcccttccatttatttaaaaaaatttagatttcttattctaaatgttggattgcctagattgagcctaattttcttatgttctcacctttgattttcatcttttccttttcctgagcaattctcttgtaatttatcctacaaccctcctactggcttccacatttcatttataatatttttacttttggagagctcctgcattctgattttcatagcattctgttcttgttttgtgggtgcaatagtgtgttttatttctttgaggatgtgagtcatagttgttttttttaactgagcttttttctgaccttatagattatgtttcctctaagattttttccagattctttctccccctccttatctttttgataatagattccctccaatgcctatcaaaccctggacatacattcatactgtgatgctataaggtgctgactggaatttctgggtggaggtatcacttgttgatggtaacttcattataggatgagtagtgaaggcagtgaatttgggtcccaaacgtcactgtgaagacatctttcttttagagccattcattttctctagaaaataatcgtttagtcccctgccaggagttgtgggagtagtacacgtggtattctggggaaaatgactgagtgcccttgaggtcagccagattttcacttaaacctctgctttaccttctcttttggagcttgtaccctctaaatactatccaggttctataaagagtaaatctctcttataaggaagaagttaagggtggttggctgatttcaacaaggttcctgccagggtttaatcatacctgcatagacttccagccagtcccctgctaaaacccacacacttctctccttctttccaagttgcttccaggttctcgtccatgttttttgtcttccaagaagatattgaaatgttttctctgctcatgtctctcctctcatgttcttcttgtgggttaataacgtttgtactcctttactgtcatgtttgttgtagtttgcgaaggaaaggagatagatatatgtgattaaccttccaggttgagctaaagtctggctgaatatttttattctgtagtagaagaaaaacttatttatgtactcccagatgcaataaaatttggatatccttaaacaatcctaagaaagaaggaattcattagtatcacattttaatgaattctgaagcacagaactgtgtgaatcgagaaaaaatcagaagtatcagcttctcctccagctaacttttggaatataaataccttttgccatttacctaactgtactctacatcaagatggcatacctttaaataaaaacattttaaaattaaaaactaaaattctgttttcctctggatgtaccatgtgacttttctgagcacacgtgattcgcggtttttgtgatttatttttagaggagaacactaaagaatggaacaaccacagcttgttactttgcaacaattcacactgactcatctctgctccttgccgacattacaggtgagcaaatgaagcatgatttatgggcacctcaagcaaagacagccagaccatcgtggcaaacaacttatatgtacttttgggcagacctgccttttaattgctagaacatgagcattacattttttgcaagtaattacgtgtctatatgtcactgtggcccttaggaaattttctaaagtacttagaaaatagaaaactgtatcatagagtgttttctattttctaagtactctgattatttacttacaatttttggttacagaatgatatatatgagtctgaattttgtgtattaatttagggctttttagggaaactttactaattctagttgtggtaatagtttcttatatcagcagatacatggtggctattggctagagtcagggcactgtgctagatgctggaaacgcaatgagataaaaaatagtctctgcccttgagaagccagacagaatacctacaccattgatcactaaccttagtaacaactatggtgctgttactagacgtctagcattgtgcaaagcactctggaagaattagttcagcagcaaacagccttctgaagtggttactgatgtcctcatgttacagatggttagactgacgctcagagaggataagtaacatgcccagggttgcacagctagtaagaagagctgattctggattcgggttgatgattccaaaacttgtacccagcacagtacctggcacatagcaggtgctcagtaaatactgttggctgatacactgatgccactgtttgcttatgcaaaagacctgacctaatgggtgactctgaaaatagatactacagtcttcagagaaggcaaagagaacccagaactacgacatctgggaaggctttatgaaagggtcctttaaactgggctttgaagtaaagacaagatgaggagaggacaaactgtcttctagataggggaaggacacaggtatgggaacaggagtgtcaatagtggatgcagggaccacagtagtttaactagaggagtggattcatcgcctgggggcagtgggagaagagggtaggcagatgggagggttcacattgtagaagagctcaaatatgcaccaaagactcaaaaaaggttctgagtccaggtgtgagtgatgtgatgaaagtggtattttaaggaagattaatctaatggccagttatctaaatgaattacaggggaaggagagaggcagaaaggtttttaaaaatctcttatgacagagatggagacactgtaaaaacaattaccattgtcccatatagcctcagctttcttgctgaaatagaattcttccagcacctttgatgaggactaggttctagtgctgagagctgctagtaagactgcgtaaaattcctcacagataatattggcattgtttcagttaagaatagtatggccaggcgcggtggttaatgcctgtaatcctggcactttcggaggccgaggcgggcggatcatgaggtcgggagattgagaccatcctggctaacatggtgaaaccctgtctctactaaaaatacaaaaaattaaccaagcgtagtggtgggcgcctgtagtcccagctactcaggaggctgaggcaggagaatgacgtgaacccaggaggcagagctttcagtgagctgagattgtgccactgcactccagcctgggcgacagagtgagacgccaccttaaaaaaaaaaaagaatagtagcagtatgttgcctagataaccacatgcctgacaccttatatatattattgcatgtattcctcacaaccctacacatagcagagaacactgtacatatataggtttagaccttaaccaaataatatccaccacctggagtaatcagaggaataaggaatcagtccaaatctttccaattccagtgctcatgttcttatccctcagccattctgtgttttgtctagaagaggaccatgatagagagagggagagagagagatccaagggatggtggtagagtaggagacaggagggagattgtaagttggggtagaagaagctgagtgtaggtatgccaatgactaagagagtctttctttaggacctgagactgtttgctcctttaccatgtgataaaatgagagcaaagatagttacatatttaatgaaaatatagacacactggataagcaaagggaaaaactgaataataacttaaaaacacccagccaagcacagtggctcacgcctgcaatcccagcactttgggaggcccaggcaggcagatcacaaggtcaggagatcgaaccatcctggccaacatggtgaaacactgtctctactaaaaatacaaaaattagctgggcacagtggtgcgtgcctgtaatccaagctactcaggaggctgaagcaggagaatcacttgaaccagggagttggaggttgcagtgagcccagatcacgccactgcactccaggctggtgacagagtgagactccgtctcaaaaacaaaacaaacaaacaaacaaaaaaaccaaaaaacccacctgacagcctgagaatggggatgggggaggtagtgggttaaagtgatgaatagaaaaacttttactgtttactgaatatagtagggaatttgtggtggttcttgttcttaagtggtgtgatggtggatgatcttttacattttcatttatgttttccatatatgattttaatttaaaaattactgttgaaagcttagaaaaagtactgttttggccgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcatgaacctgggaggcggagcttgcagtgagccgagattgcgccactgcaatctggcctgggctaaacagcgggactccgtctcaaaaaaaaaaaaaaaaagaaaaagaaaaagtactgtttcagaaacaaacatgccttcatattctttttgtgtatactttacagataaatttggacagcgggcatttgtgggcaaagtttgcatggatttgaatgacacttttccagaatacaaggagaccactgaggaatcgatcaaggaaactgagaggtaaaaggcccatttgtcttgatttgtcttacaggtgaattcctgtgctgcactgatggagttagagatggaaaaaggaaacaggatactgttatcacccagttgggatgtgcacatagtgactcagaatgttctgtttaatgcaatgggtcggttagtctacagtgaatttgatcaaacactcgataatcattaatgatttacaaagagctttcctttgtagtgccacacttgatcctcatagaaatctccatgaagcatctgtctttttatttattttttatttatttttattttttttttttgagacggagtctcactctgtcatccaggctggagtgcaatggcgtggtctcagctcactgcaaccttcagctcactgcaacctctgcctcctgggttcaagcgattcttccacctcagcctcctgagtagctgggactataggtgcatgccaccacactcagctaatttttgtatttttagtagagacggggtttcactatgttggctgggctggtctcgaactcctgacctcgtgatctgcccgcctcggcctcccaaagtgctgagattacaggcgtgagccaccacgcccagcccacatctgtcttttatgataaggaagctgagtctgacataggctaagaggcttgctcacagtcatacagcttttaagtagtggagccagaattcaaaaccagggtctatgactctaaattcaaagttcttttttttttttcttttcttttctttttttgagacagactgtcactctgtcacccaggctggagtgcaatggcgcgatctcagctcactgaaacctccacctcctgtgttcaagagattctcctgcctcagcctcccgagtagctgggattacaggcacgtgccaccacacccagctaatttttgtatttttagtagagacgtggtttcaccaggttggccaggctggtcttgaactcctgacctcaggtgatccacctgccttggccacccaaagcactgggattacaggcatgagccactgtgcccggctcaaagttctttctctcatgatatagatcacacctcatattcaatgtaagtaaagagaataaaagagagagaaacagagggtatgcaagaatacttgctatggcatgtgttaatttaaaaatgatgatggaagtgaataattatttgtgaaataaaatagtatacaagaagttaggaaaaatgagttatagttacaggttaatgaaagactttcactacaaaaggatttttttaaaagataccaaagtaatatgtgtttccatggtccagaacttagagaaacacaaaaaggtataaagaagaatttttttttgtaatgaaaccaccaaaagttaccataatagggtatcttttattgttttctcaaggtggtatatgcatccttcactactatttcgtcctaccttgggaacaggaaagttgttctggatgtatgctgtaatggccataacaggctaatatagggatctagaatatcccctctccacaaaggtgacctgaaagaacatctctgcaagctgaaatgcaggcatacaggagggaagatgtggttcctttttctgctttggttctacatctgtgctcctagggaatagggcctcactctactacctgtaataaaagctctgaggatgttatgtggtgacacaggctagagagagaccatgggagggaccaaggcccactctgctgctgctggacattgagctggattcccaaagattgtggacagcctactttggaaagatttccacctcaaagaataggataccatatgcagatagaatcataaaaagtaaagatgtgcaaggaaaatgaaaacatgtttccacgtaaagacttgcaggtaaatgttcatagtgacatcatttatagaagacaaatgcagagcaggttcactgcacataggtatcaatcccaggggaggactctaaacacctcaccaatactgcacaccacttgcatgaatctggtgagacagcacacttatacaacaagttaagcaaagcaagtttattatgcacagataggtagcaagggacaatagaagccttggtgaactgatcctccacggctcaggaaagttgcccaagagtctcatatgtgcatgccccacatcacatcatagctgagggaccctgtgagcatgctctacctgtggttttatacccagatgaaactggtctcactgagctaaaacattgcagaacatcctgttctaggagaaatgggaacagaacccaggctgttctgaccagtttctccatatctcagggtggttgcatttccagcacattctacagttattctgataactacaagtaagaaaaggggaaaaactgggtcaccaaggccatatgagaacttgtcctgcaccaaatagtggaaacaaccaaaatgttcataactggtgaatggataaacaaaatgtggtatacaatggaatattattcagccataaaaaggaatgaagcactgatacatactacaacatggatggtttttaaaaacactgtgctaagacaaagaaaccaaacacaaaaggccacacattgtatgatttaattgatatgaaatgtatagaaaatgcaaattcatggagacagaacaccagcgattgcctggggctggaagtaggaaaaactattttttttttttttgagacggaatcttgctttgttgcccaggctggagtgcagtggcacattcttggctcactgcaagctctgcctcacaggttcatgccattctcctgcctcagcctcccaagtagctgcgactacaggcgcccgccaccacgcccagctaattttttgtatttttagtagagacagggtttcactgtgttagccaggatgctctcgatctcctgacctcgtgatccacccacctcagcctcccaaagtgctgggattacaggtgtgagccaccgtgcccggcccaggaatagctattaactaaatgggcccaaggaatctaactggggtgatgagaatgttcaaaaactaggttatgatggtggttgtaaaacgcaataaatctactaaaaatcatggatttgtgcacttaaatcaggtgaattttatggtatgtaaattatacttcaatataaatagtttttaaaaatagcagtatgtgggtgagattgtgttcatgtacatttgtgttttctagttcacatccactttagataagagttgagtagaaagtgattagatttttttaaaaggaagattttgtacagaataaatagctgtgagcatatttgcagagactccagctctctgtgattttctcctgtggtacagtagtgcttctcttgatgcttctagcattcttcccctcacttttctcccttaatcacacattgttgaagccaaaaccaaaaaacgcctgagaagctcaagatgtattaacacactgcgtcgaattaaagttgaaagatgattaatgcactgaggcattcttcctatttgccaaggtcactgtgtgggtttgtccaacttgaatgtcaatattatttttgtgtaacaaattatatttaaagcctgcaggaacttgctataggagtcctagggtaaatcctcttgtaaaatgaagtaaatcatttaccctctccctaccctttattatagaccagggcttctcctgtagattggatttgcttttaagtacatatggcctgctcattaaattacttttggttgtgggtcatactatggcttgagattatgaattttcattatgttctttttcatacaacattgggagattctactgaccatataaatacttttcttatattttaaaatggcatttctatagtaccttaaggatttgacaagaaattgtattggtttatttatttatttttattttctattttttattttttttttagatggagtcttcttctgtagcccaggctggagtgcagtggcacggtctcagctcactgcagcctcccactcccgggtttaaacaattatcatatctcagcctccctagtagctcggattacaggcccctgccaccatgcccagctaatttttatgtttttagtagagatgaggttttgctacattggccaggctgatcttgaactcctgacctcaagtgagccgcctgcttcagcctcccaaagtgctgagattacaggcgtgagccactgcacctggccaaaatgtaattttattctgttcaacatctaagagatacagaagaaaatgctttagatacaaatctttgccaagaccaaacatattctgatgcaggttttagaagttcagctttttttctgttccccagacccctttccccttaaaagtgtcctctgaaaagggagcagaggggctgcttacatgctcacagagaggaggaagtacccgccttcctttagcatcagcctatcccagcttatctattaatccatttttgtggtgatagtaaaccttaattctcattttgttctgaaacaaaggaatgccagaaggcagaaaactacagctgcctagggagggcagaaagagccatttcatagtctttacagttgccaccatccctgcaggcataaactggtgggatcactaccatcccattccccatgcacctcacaaccaactctcgccttttccttctgctttactccaaggttcatccccaagagaactctacccttgtaaataaatggtgatgttgtgggaacaagtagcttccactttaggagaattcgaagtaaagagcttcatggcttctaaaagcctccaagtgcataggacttcatgactctaacaaccgtagagcataatatattgcaacatttctccaaacggagcttgagctagtagaacagcttgagtgctgtgggaatatttgagaacagcccgaccgatgctagatgataacattacgtttccctgtgattttgcactccatctctggctgcaagtaaaaaagcagagtaattactacttgttaatctttaattagtggtggtggaacatgtgcagcattagaaatgtttgcatgaaaatcaggatatgtaagaatcatgtttttatctttttaaaatgtttatttgaaaatggtcggccggtcgcggtggttcacgcctgtaatcccagcactttgggaagccgaggagggcggatcaccaggtcaggagatcaagaccatcctggctaacacgctgaaaccccgtctctactaaaaatacaaaaattagctggacgtggtggcgggtgcctgtagtcccagctactcgggaggctgaggcaggagaacggcgtgaacccgggaggcggagcttgcagtgagccgagatcgcaccacttcactccagcctgggcgacagagccagactctgtctgaagaaaaaaataataataaagaaaagaaaaaaagaaaatgctcaagttttctaacccatttgttgctttatttcagatttgtgtcagaaatgctccaaaagaacgtgagtaactttgttcagagctcgcttttagattgcctttgcattagctgtaggattcataaagttgcttgatagtgattagtctgtgtacgactggcttatctcatgcatgtagaagtatttacctagagcctgatgtgtcactgtggactgtcactgtcagctcagtgaagtcagacatttttaaaaaattatcttaaaatatttaattgacaaaaattgaatccactcaaggtgtacaatgtgatgatttgatatatttatacattgtttattgattattagaatcaaatttgttaacacatctattcccacacacgctgtacactagatcctcagaacttgttcatgttataactgaaaatttgtaccctttgaccatcatctccccacataagccagcaatcccacttttgggtgtatatccaaaagatgcaaaataagcatcttgaaaagatatctgcacttctatattcattgcagtatcattcagaatagccaagatatggaaacaacttaagtgtctgtagacagacaaataaagaaaatgcagtgtatatgtctatatacaaacacaatggaatattattcaaccataaaaaggaaggaaatcatgccatttgtgacaatgtggatgaacctacagcccattacaataagtgaaataagccagccccagaaagacaatactgcatgatctcacttatttgtgaaatctaaaaaaagtcaaacttatagaaacagaggtcaggcattttttgctttcttgggggcagctctgtacctagccctctgtgttttgttttaaatacattttgaaataatgaaatattaatgattttagtggatttgtttagatatcgttcacatatgtacaaacatcaaacttgctttattcttaaaattgtgtgtacttttcttggctcccaaaccccatgcctacatgcaacagaaaaactaaatttcgtcaggcaggtaaacttcgtcttaagttcactaagcttttagttgatccaatttttattaggacaatctcagtcactgctcaggttagagttaccgtctcagggtaggtttttcttcctcagtggttttccttacccccctctgggatcttctgatttcacaggattggtttctggcaagcagggacagggcttgatgggcgtgggctgactggtggcacctggaagttggggactgcttggtggccacctcaacattggctctggccacttgtgcccttggtctgctctgtaacacaggcagtgtctagtcctatgcccctgccactggctgtcttggtccctatgtgtgtgacacctcacatggcctgcaggcatgcagcaggcaccccctattgtggtcccctggtgttggtgagcctgtggagacaatgctgtttcctgcctccacccctaacaggctggcatgtggctctgtcaagcaatctcttagactggcaagcctgacccttccctgatcatcttttggggcctgataggaaatcataagaaatctcaaaatttctttccatctaactttgggagatttagatgaaactttgtagatccttatcctcactacccctctatgagtccttctctcctgcctggccactcacctcaggtgccaccagagccaatcctacaactgaatagtgctcaggaaggctgtaaccagcacacctggacaagatgtattcccaaaatggaatcggctatcacctcacttttagtctccccagcactcttttaaaacttcagcctccacttttcttcataaaggctacccagtctagccttcatcagagccttaatgtggtggcagaggagcatctgtcatttgggataggatcttttgttgaacttgggtgctgaagaagataccctcctttattctccactttgagctgttttcatgaaaccccgtacttccaccgactgttagaatggaggactgctccccaaaatgaagacacaaaatcatcttgctgtatgatatgcattttggggtacccttcacattcatgatatccatagtttcctttttttgaaaaaacttttaagttcaggggtacatatgcaggtttgtttacacaagtaaatgtgtgtcataggggtttgttgtgcagattatttcatcacccaggtattaagcctactacccattagttatttttcctgatgctctccctccttccatcctctacctgccgataggccccagtgtttgttgttcccctctatgggtccatgtgttctcatcagttagctcctacttataagtgagaacatgcaatatttgactttcccttcctgcgttagtttgctaagaataatggccttcagcttcatccatgtccctgcaaatggcatgatctcattctctttttatggctgcatagtattccatggtgtatatgtaccacattttctttatccagtctatcattgatgggcatttaggttgattccatgcctttgctattgtgaatagtgctacagtgagtgtatgtgtgcatgtgtctttataacagaatgatttatttccttttggtatataccctgtaatgggattgttgagtcaaatggtatttctgtctctaggtatttgcagaatcaccacattgtctttcacaatggttgaagtaatttacactcttaccaacagtctataagcatttctttttctccacaacctcaccagtatctgctatttttctgactttttaataatatccattctgactggtatgagatggtatcttattacagttttgatttgtatttctctaatgatcagtgatgttgagcttttttttcatgtgattgttggctgcatcaatcatatgtaaaacagtgaaaagtgtctgttcatgtgctttgcccactttttaattgggttgtttttttcttataaatttgtctaagttccttatagatgctggatattagacttttgtcagatgcatagtttgcagaaactttctcccattctgttggttgtctgtttactctgttggtggtttcacttgctgtgcagaagctctttagtttaattacatcccatttatcaatttttacttttgttgcaattgcttctggtgtctttgtcatgaaatcttttcccatgcctatgtcctgaatggtattgcctaggttgtcttccaaggttgtttttttgttgttgtttggttggttttttgtttttttttgagactgagtttctcttttgttgtctagactggagtgcaatggtgagatctcggctcaccacaacctccgcctcctaggttcaagcagttcccttgcctcagcctcccgagtagctgggattacaggcatgcgccaccacgcccagctaattttgtattttttagcagagacagggtttctccatgttggtcaggctggtctcgaactcccggccctcaggtgatccacctgccttggcctctcaaagtgctgggattacaggtgtgagccaccacacctggcccttccagggtttttatagttttcggttttacatttatgtctttaatccatcttgagttaatttttgtatatgatgtaaggaagaggtatcaattgtttttaattatctccagtattctagagtgaagcccatagtgacaccacgtttttccctctcctgctctgagactttgatgggtgaactgggcaacattgctaaaacccgtgatttgcacattcaggtgggtattcttcttctctttatgcctctatgcagacctgcaagatttctcagcacccttaaatcatcatttccaataatctgtagttgttttactgagtaatctgtttcttcaactgagatatcctagagtcacagcataacaggagagaaaggacccctgtagatatcacctaatccaattctttcattttgcagataagaaacctgaagttccttataccctcaatgttttctgatcagtcttctaaagacaagaaaatcgttttaagtagtggcaagatcaataacagactgtgatctgttctctgtaggatacatttaatgcatttatttcctacttctctttcacttgatactttctcagtgtgttctgtaccttcattcttagagaaaccagctattatttgaaaagcaaaaagagcctaatttccaccttacaaaatagcatttaaaatcccttttgttctgagtttcttaatttaaaatcagaacaaaaaagtataccttgctttgtcattaaattgttgcaatttaggaataaaacacttttttaaagcttatatctgggttaaaattgagagttccccttctcccatccaagcttaattacatactgtactaaaatttctcctcttaggagttgacggtcttataagaaaggtcagatcagggcagagacaacacattgattctttaccatttgtaaatcagtgtttttttggtttttgtttcccaaatctattttcttaggaaccattaaccgctctcaccttccctattattgttattattatttgcagcctataatttttgaatttttaattcagtcccacacatttctctgctggagataaaattcaaaacttacctgatgtttctgctttgcaaacaaaatgcttctgtcgccgacaaaataaaatacacatgaacatttaaaaatacatgaaaaataagatgagaagaacacacaacaaaatcaagtttatccttgctagagagatgcatgtggatgtatgcacatttactcacatttatccaaatgactcgaatcatcagattgtcctttcttctgttgctgtccatgcatttcatcggtggtctgggacttcctcaaggccagggatggagttcattgtctgagtaaaacacgtgttttcagaacattgctatttttttcttttaaaaatttagctacgcatattctaaatggcattgccattcttggaagtattaattatgccctcttagattttgtggtgccctagagaaaggtcttaggggcctttttcagtgtgggggcataggacttattgttttgcttgcatgtggattcttatgggctgtttcttgatgaccgtggaattttctagctcagctattttcaaactcttttttggagaactcattctggaaactaacaaagggcacagaatggagacagggtcccagagtctcaatcctgctgcatccggaggggcagtgcttttatgccttctatatattgggtttctgtgaatttttatatgaataatatattcagtgccgagagaatttggaaaatcactcatctagcccaacccttttttttttttttttttgaaagatgggaaaattgctgtccaaagaaaagaatgactttctctaggacacatagctgtcagaacttgggccaaacccagctctctttactcaaattccagtgttcatataagtgaaccccactgtctgcttttttatgaacactgagctcttttcttaaacggccagtatggccagtcacggtggctcacgcctgtaatcccagcactttgagaggctgagcccggcagattacttgaggtcaggagtttgagaccagcctggccaacatggtgaaaccccatctctactaaatatacaaaattagccaggcatggtgacacatgcctgtaatcccagctactcaggaggctaagacaggagactcacttgaacctgggaggcagaggttgcagtgagtggagattgtgccactacactccagcctgggcgacagagccagaccctatctcaaaacaaaagaaaggccagcaccagaagaggcaggttgctagggtcctgactatcttcaaggaggacttcatatttgttccagctggaggtcagaatttgaaaagactttgttggaaaaatttgtcttgatattatacatacacatacacacccacacccacatccacacacacacactacatgttcataatattcagtttctttgtcatatacattatattatctatgatgaatataattgtttctaacaaaatgcatgtgtaatcttcattgcctttctatgtggtcccttaaataggcaagtagaaaaccattcacaccattttgaggtaggaagtgtaatttctaatggtattttacagaagaaaaatgaaaatattatttttttcttgtagagccatataagtgaaaatcgtgatgaagttgaagctgtgaaaaacttataccccagttataaaaactacacatctgtgtatgataaaaacaatcttttgacaaataaggtaagttttatatcatgacataatctgtttaaaggagggcatatttatctcaattttaaaatctcaatagtaatcttcagatttctgatatgaatacatttctttaaaaattttttttaaagttttaatttttgtgggtacacagaaagtttatatatctatggggtacatgtgtatacatttcttaaattagagtaaagcctagtgtgtgtgtgtgtgtgtgtgtgtgtgcgtgtgtgtgtgtgtgtgtagttaaaaatggacccgaagtttcatcttagtgaattaaatgtaaaggcttcattgaagatgggaatgtcatttggtccaaggacattttaacagtatctattagaatgtaaacctacatttctttgagtcagcagatgcatttctaagaattcactctaagtaatatgaatagggatgctaattttatattaaagtttaaaaattgttatcggtgagggattaaattacagagcatacataggattttatccagcattcacaaagaaagaggtatgcaggcttacaaggaagaatgtttgtgtaatattatttgatgtgtatgtacatatgtatagatgcatgcttacttagaaaaaaactgtctgaaagacacaacttgagtattaaaaatgactcttcctgagggacaaaccagaaggactttctgctttttatttttaaatactctgagagtgcttttaaaaaatgagtatgcattactcctataattaaaattaatatgtgtgaagagacctcattacaataatgtactacttggccttggccttcaatgaaatgtacaaaccgcatggagagtttaccatagcaaataatttcttagtgactgtgtgaatggagatatgaatataactgatttaaaaggttaatactttgcataaatcatgtaaaagctacaccatagttttcattctttatatattttccatatgattaataaattaaccttccatttgcatgttaattttatttgaacagagattgggaaagttatattttaataataattctgtagtcactgggccgggcctggtggctcatgtctgtaatcccagcactttgggaggcagaggcaggcagatcacgaggtcaggagatcgagaccatcctggctaacacggtgaaaccccgtctctactaaaaatacaaaaaaattagccaggcgtggtggcaggcgcctgtagtcccagctactcgggaagctgagataggagaatggcgtgaacccaggaggcggagcttgcagagagtcgagattgcgccactgcactccagcctgggcgacagagtgagactctgtctcagaaaaataataattctgtagtcactgaaccgtgcctctcaaaggggaaagcaagttgggtacaggttttgtactgagagaaaaataattttgaaagagtaaagtcttatttaagaaaatctacaaataaatactaccaacattaaaaatttagagaggtctcatgtgtgtgcagtgcctgctttcttggatcaattttactttctgaattaatgattataagatgttaaatttcctagtttttatgaaaatataaacgtaggtgagttaaaagtttatttagttgaaaatatcaaggccattggcacttacattgaagctaggagcagaaataaagaacagcgctttgcaggattactctcacagctttcacatactgagaagggacttttagttctagaaagtttttttagaattggagcaagcacaacactaccagttgcttcccatataaacttagaaaagaaagtaacttgacagtcttctaaagtagagatgagaaaatcatgttatcttccatctggatggatattctgtgctgtagatcacctggaccaaaccctcattactttatagatcaacaaaaagaatctaagtaaactccacaaatttcctgagactttcgtaagacaatgtgtttacaggccttttctaaggtataacttgtacctagcaactttgtacatatagatcatcataaatgttcttgtgaagatgctaacagccaagctacagcttcggtctctctctaaaataccttgtgagtgagtacccacttaatcatttgtgagcggtaaactccacgtagggcactcttctctccagacagtgatggcacacggctgctacctctctgcagaagaactgaacgtattccatgaacgaggagcatccatcgcacactgtcccaattctaatttatcgtaagtagacaatgattgtttggtagattacgaatgattgggttgcagattagcagccaaatgcctttgtttcctctgtcattcctccaggatctcccctctattctgtgtttggcaggacccagatagatagacatttactcgtgctgttgaggagtaaaagagaacacgtaagaggacatttatctcagaggacacgtgaagagcacagcatcttctgaaatctctgagtttgtacaaaaaaaggacaatagggaatacaacataaaaaatttacagtgaaagtactgaaagaacccatatgtcagccaggaaatccagaagagggtagtcactcccattactgtttgtgctgtagtgtgagaaggaaacacagcaataccaaagcaaatgcactatgatgtatgttaccctgttggacctgacggaatgccagcccacacaggcaagcccaggaggaccttgtcctattataattccccagaatacagaggtgttatttattaactggttcttaaccttttgaaaggtgatggatccgtaaatgaataaaatgaaagttattgcctgggcgcagtggctcacatctgtaatcctagcactttgggaagcagaggcaggcagatcacttgaggtcaggagttcaagaccaccctgaccaacatggtgaaaccccatcagtattaaacatataaaaattagctgggcatggtggcaggcacctgtaatcccaaccactcaggaggctgaggcaagagaatcgtttgaacccgggaggcggaggttgcagtgagccaagattgcaccactgcactccagcctgggtgacagagtgagactctgtctcagaaaaataaataagttatagcctgtaatttcaggggaaaaaagcccatggatattacaagtgttgcatctaatttcagggaattcatagatctcatgatgccagtccatggatgctaggttaaaaacccatgcttgtggctgtaatctcagaaaacaacttcaggggtcgggcgtggtggctcacacctctaatcccagcactttgggaggccaaggtgggcggatcacgaggtcaggagatcgagaccatcccggctaacacggtgaaacccagtctctactaaaaaaaaaaaaaaaaaaaaaaaaaaaatattagccgggcatggtggcgggcgcctgtagtcccagctactcgtgaggctgaggcaggagaatggcatgaacccgagaggcggagcttgcagtgagccgagatcgcgccactgcactccaacctgggcgacagagcaagactccatctcaaaaacaaaacaaaacaaacaaacaaacaaacaaaaccttcagggaagtaaaacagggaagggaaagaagtcagtgaagatcgtatcatcacggaagttaccactgtgggctcccggagtttaatccttctatttaatagaaaactcaggtaaccagtgtccaaaacagaactcaaagttatcctgcccaagaagtgagggagctggctgtgacagtaatacccaaatgcttatgggttgttgttgagggctcctgggcagagtggagaagagtattaattccctggaacttctggccgtccccaaacaagggcagagcaggctctagcacaggagagagctgagaaagctcctaggcaaagagctggaggcattcacagttggaaatctagggactttgcaaattacaaagatatatgtcagtgtcattatgggaagggtgctgagagccacagtgacatatttctggagtgctttagggaccccagaggttctgagttttcagacttaaaggagtgacacagggaatcttgtctatgtacagcttagtgactataattagggtctagttacttgatagtggaaggatttaacacccattgggtgttaatatcctctaaattaaagcataatctagctttgcaaattgagttttgaagttaaatttctttaggacacatttctgtttaaatggtcactgctgttctttctccagcaactgagagatttattatgtatgcaccagggctttcaaaattagagttatgtgcatcttccagcaaaccactttgacctttgcaactttttagaattctaaggatcaccttagttttcctttgtctctttagaaaggcagcacatggtgggcatggtggctcatgcctgcagtcccagcactttgggaggccaaagtgggaggatcacctgaggtcaagagttcgagaccagcctgaccaacatggcgaaaccctgtttctactaaaagtagagactggacatgctggcgggcacctgtaatcccagctactcgggaggctgatgtaggagaatcgcttgaacctaccttgaaggagatggttgcagtgagctgagattgtgccattgtactccagcctggatgacagagacagactctgtctcaaaaaaaaaaaatatatatatatatatatatggctggcacatctctttagctcagagtcacaaggtcccaaattcagcccaggaaccatctatcctactttctctgtcttcagaggcagcgtttgaacagtcaggtcctgactttttaggctgcacccctttttctagttgtactcccctttttcgatcttaaagtcactactcattcagggtaacaaattattccaggcagagagaataggtaatgctttataatttctgcttcctaacataaaaagatgtgttggttagaaaatattaaagacagataaaagacttttgtattaattgcaaagtttgatttcttcatttttttcccatacaaacgatcccctgcttttccttctggctcttgctgctttgtgcccacctgagattaaccttggcccaaggattaggctattttatgatcctgtttactccaggacttggatggtctgatttgactaatatgtttgtgtcaacattagagccgatatattgggaagcacaattttcagtggcatcaccgtcattgttattagtgttcatcttttattggaaccacatggatctccttgttctgacatctcctctctctacaggctcagcagtggatttctaaatgtgctagaagtcctgaaacatgaagtcaagatagggctgggtacaggttagtagttcaccatttggagctatggcaaagtggttgattactgtgtaattttctaatgtgactaatttgcaggtgactgttctgtttaaaaaaaaaaaaaattagttttgggccgggcacggtagctcacgtctgtaatcccagcactttgggaggctgaggcgggtggatcatgaggtcaggagttcaagaccagcctgggaaacctcgtctctactaaaatacaaaaaaatagccaggtgtggcagtgtgcgcctgtagtctcagctactcgggaggctgaggcaggagaatggtgtgaacccgggaggcggagcttgtagtgagctgagactgcgccactgcacttcagcgtgggtgacagagcgagactctgtctcaaaaaaaaaaaaaggaaattgtatgcaaagggagaagttttgatgatactgacctcctgaaagctgttatccctgtttattattcaaagattaggctataaaggatgattaattccttctgacgtgtttcagaggtattctaaaaagtccttgacttttgttttgttttgttcttctggctaggttttaatggtttggatttctatatttttagttttcaataactgtcattacaaatgctgtctcaaaagaaatttttttgtccttgccatagtgagcacagattcaatctatgacagaattgagaattcggatgtatgttaagaattggttttgcttttaagcaacgtttagccaaatgagacctctccatatccacaggcagtctgcttgtctactaggctgagggatgttctaagtgcatatgaattagtgacggattagtgatgtttcctttcttcacagtacattttaattgtgtttcttgagagtgtgcaagcgttgcttgcttcgaaagtgtgagtcaggcccaaatttctaggtgtcctctgtgaggcttcttttatgactgaatgactgaattaaaaatttttttaatgggtatggggcaggaggacgtgttttctgttcttgatgcctttatcttcctcatatttaagagcatcaggctgtatgcatgttgacactggtggttttcatcactttctgcaggaactcaagtctcagtttgttatagtgagacattttacaaagtaattaactggtaagacacaataatacgcataatgattttactgatattttgaaagaggtatatattagattagaagtttttccctattttatgggaatcaaagtaatcaagattttgaaaattctaatttaagcctgaaatcatcaagattgtgataattctacataaagtcacaggtgttaaaggaggaaaccagtgattttatgttcacaaaaaagcttcaagggataagaaaaaaatggccaagagttttggttacacactatagtcagttaatatgaaaaatttagcagacacataaaaatcagtcagatattgttttcagatattctaggattttggtctccataatttaagttcatcacatgacttccttttcttgactttggattgtttagtgatggtctataaagttcaagttgagttctagctgtcacttattatctgtaagaccttgagaaaattaattttctagtagtttttagtcaaggattcatttcctgatttctacaacaatagtaactagcaattacaactatgtctatcttacaagctgtttagagaattaaactttaaaatgcatgcaaattggttagcacagtgcctgcctggcacatgacacaaatcaatcaagattggcttaaaaaggaaagggcgaagttggtgtattgaccaaacgtttgaataaatatgacctattagcttatttactcagaggatggtgtttcatttttacctagtcctttttgcaatttagtcaccctctactctactatttcctaaacgtgacttttgtgtatcaatttacccttcaatttgtaaactttagaagattattatacctcatactatgaatagagagcaagtccaagagcaattcacacaccctgtctataacaagtgcaggcagatcttgacttgcacaaatattaggtagaagaaacccacatgaaatttaacagaaatatagcaaaacaagataaagtgatatcacaaacaataagaatgtgaacaaatatctgaaaatgatctgctttaggatccagaagaaaatttcagaaaattgccttcatccctggagtacaggaaatcatggttctatgaaaagattgtggtagaaattttagaaatcaaggaagaaaactgaaaaaaatcagattaaaaagcacatagactctcatacactgatggaaggagagtggatggtacaactactttggagaatgttttgggagtttcttctaaagttaaatatacgtctacatatgacccagcaattttactcttgggtatttaccctagagaaataaacatatatgtttgcagaaatagttgtatgaggcccaggtgcagtggctcatacctgtaatcccaccaccctggaaggccacggcaggaggattgcttgagctcaggtgtttgagatcagccttggcaacatggcaaaaccctgtctttacaaaaaatacaaaacttagctgggcatggtgacatgcacttgtaatcccagctacttgggtggctgaggcaggaggatcgcttgagcttgggaggtcaaggctgcagtgagccatgttcatgccactgcactccagtctgggtgacagagtgagaccctgtccctaaattaataaataaatgaaagaattgtatgaggatgtttatatcagctttatttataatagccccaaaccagaaacaatccaaacatctatcagcaggaggatggataagcaagttgaggtatattcatataatgaaatattatttagcagtaaaaaacacactacagatatatgcaaaatgtgggtaaatatatgccagtgtgtgggcttaaagagcacacactgcatgattccatctgtatgaaactcacagaccaacagaactaactgatattggtagaaatcagaaagtggttgccaaatgttgtaggtaagaatttggggaattgacaggaaaaggccatgagggaatttgctggggtgatggaaatgtttaatatcttagtttttttgcaaaatagttaatgctatataattgttaacattctccaaactgaacatctaagttatatatgtattatgatattttagttatacctcagttaaaaaaatgacaaacccaccaaccctgtaggaagctatgagaagcagaattattgttacagaaaatcaaatcagtgatgtgagaataaaatcaaccaaagatgatagaaggtgtttgaggatgatcgatgtgaagcccagaaaccacagagccaacacatggggtttttttctgatggagcacccagaacaaatgggacagatgcaatagtcagagctttgaagggtaaatcttttctgagcttaagaaagaactgccttgcaagtgcttaccctgttttacgctaaatcgtaactgaacatgttgtgacaaaatattttaattacaataaaaaaatttctacaatattgacacaaggaaaaaagtcaattatcaacaaaacaattaaaaaccagtttgctttcagatgtttttgttggcacacaaaataccaaaaggcaagaaaagagtttggagacaaagcagtgttagccaagaataatatatctggccaaattctcctttatgtaggaaggcaacaaaattctcagctatacaaaaacttggaaaatattttccttaggaaccctttgaaaaacttacttgaaaatctacatcattcaatgaaagatgaggcaaatgaagggccatggggggaaataatggcacaatatgatgtcatggaaagctaacatcaatcagaataagaagatcaaagaattgtaaaggagtttaaaaaatgaaagtaaaagccaaaaatatatctcaagagagaataggcacaatgttaaaaacctatcagaatggtaacataaatcaggaagatgtttccctcaggctggaaagaggttcctgggaccgaaatacatggcacttattttaaaaactgagtgttaggtccttgagttttggttttatgctttccttatgtcatttgaatgtcttcagtattttatcacaaaattttaaaaaataatatatgctctgccaaggaagaattttccaagtataatacataattctgtcttataattttattaacaaaacccaagaagttgtagtttatgtgtaaggctgagaggaggatgtatttggcaagtggccaacatggtgaaacacatttctactaaaaatacaaaaattagctgggtgtggtagcatgtgcctgtagtcccagctacatgggaggctgaggcagtagaattgcttgaacccaggaggtgaaggttgcagtgagccgagattgcaccactgcactccagcctgggtgacagagagagactcaaaaaaaaaaaaattccttgtctcagaaaaaagagaattgcacatattttacttttgacttttcagtataaaaatattagagataactacttgaagaattttaaagataggatacctcctatgtgaaatatgaaaaaaaccataaaaacaaagaaaacatagcaaataaccaaaaacactcatctgaaggaaaaatttaaacatatagaacaagtttactaaacaagacctataaactcattaaaacaagcaacatacatggagccagtgcctcacttttcagtgacaattccctatcctaacttacttcttccattattccaaaaacaacagctctttgatctcttgtagactctagtccaatgactccatgctttctcaaaatccattattctaattcgaattcttagatgtcagagtacatcactataatcatttccttggaaacattctcgcttttcatattcccctcattttctttgtattcacattgcaaaagctccacccttgattatctcaaaagtccccttctcagtgcctgcagtggagcatctggaggttgctggagaaaatcctccagtgggctttcattttaaattttgttctcaaatcccaaatggcccaccgcttggggattagagacagttattagtctgtaataagcgtatatctcctttttccaagacagcgttttctcatttcttcttaaactttctaccccaacttctagtttaaggcctccctcatatcataagttattgagaaatagaaacgaccagaaatccttccctcaatctcccaccacgaaattcacacacctttctgcatctgctgggattttctcttctttgccctgttgcagcaaaaacaacaacaacaaaacccttcttccaatcaaaggcaaaaataccaaaataccccgacgtgtgttctgtattctttccctctcccagcatctcaataaactaattcctttggccatagaccgtcctgtatcatcagtgtctccttcctgctggatcattcctgctggtacacaaacatctctagtatcttcttttaagcaaagaaacaaaaccactcctatttttttttttttttttttttgagatggagtatcattctgtctcccaagctggagtgcagtggcacgatctcagccctctgcaacctcagcctccagggttcaagtgattctcctgcctcagcctcccgagtagctgagattacaggcgtgcaccaccacatccagctaatttttgtatttttagtagagacagggtttcaacatgttggtcagtctggtcttgaactcctgacctcaggtaatccacctgccttggcctcccacagtgctgggattgcaggcataagccaccacgcctggcacaaaaccccttcttaatcagacatccccctcatgctcctgctccacctgtctgcctcccttcatggcaaagcttcttcaaagagtggggatccacactggcaccactttctaggcccttttcccttcctccaccaacttcagtctggattcttgccccaccctccgtgacaactgcttttgcttttttctcctgtgggtattaccactggaatttctgctgccaactccaaaggatgccattctgtcctcatccaatgggacttgtcagcagtatttgccatgattgactgttctctccattgtccaagtaatcttatcttgaatcctatgaagcaccttcgttcttcccttctttctcttctctgaaggctgattctcttcctctgggccatttgaaagcttgcttcaagggtcagtctttggcagtctctttgactttacacattcttcttaggaggtgccatccacaaccatggcttcatgtgatttaatatactcagatgacacacaggttcttatatccagcccagacttctctgaattctaaacctatgttttcaactgactacattctcccttctcttagacccctcctgaaggaacccccgaacttcattctatcccaaaacacatttaaacctagttctctaaaatagctctcctttttagagaattcatttttgctaactggaaacttgatcattatctttgggaccttcttctccctcacttcttccccagcacaatgcccaacctcatgactccttagtatctccttgaaccatcccctttcccctcattggtcactaccacctgatgcaagctgccatcgtttcctgctgaactgctgcaccagcttcctaatgggtctcataccatcctaggcccttccagtccattgtgatttacaaaagaatcacaatgaaaatctgatcatgtcacccccttgtgctcgtcacccttcaatgcgattttgagtgtgtaaggctcattacaaggcccacaaagctctgcaatggtttgacacccatccactgcccagcctcatctcacactactctctcctcctcaccctggctatcttttatgaatagatatggcttttatgaataacctgactatcctctctataaatcatactcccttctctcaaaagtcctgtatgcattgtttctctgtctgaatgcccttttggcctctgtttatatggctgagttcttctcatccttgttgtagtttaaatgtcattgccttaaagaggtcttccctcaccatcctatcaaaatgggcccttcatctccattttctttatcactaaagtgaaaacaacttattgttaatatatgtctgtttatatgattcttttctttctccccaacaagatagttaacttgctcatgtgggaagcccataggttttatttacaagtgcttaagtaaatcaagcacatgcaaggagtgtagtaaatgattgctgaataagtgaatgaatgcataggaaatgagcacatacctatgaaatcattttttaatctttccattgtcctctggcttaagtttttgctcttgcataattttgttagagtcttcttgtaaataatagtgtccaaatgttggctctgacgagcaagtaatgataccatcttcattgtgatggtcctgggggagtagtggggtaagggggcagatcttctgagaaaatgcttcaattttccttcctcctccacacagtttccaccctttggtcctcattcttcagcacttcagttatgtaactgaattttctctgcaattattaagatatgtgatgttatttctattttctgagaaaattgagattcacaggtcctaagtaactgatcaaaggtccgcaaagcaaaaagttccatgcgcacagtttaaaaccaggtctgtaaaatgtagatattcgtgatttctctttctatcctaccacagtgcctctagccatatgacaaagtagggattccacctacattaaatgtgttgtagatggaaggggaaaactacaaagctaatccagtcgggaagaatcggcaagttactgtcacagtggaaatccctggaaaaaaaggcttgactcttactaaataccatgaaattatgcagcccagagttctttctttgatgagcacaaaattgttttttggtttacagttattttactgacataacattggcaaccagaagaatataggatgattaaatcaacatcataaggcatctctcaatttttttccagtaaattgcatagcattatttcctaatttatacttattctttctgtaaggttaattttgagtaggtatttaggaaaatgctactttctgttatattttataccttatttttaaaactgcaggtatttaagtcttccatattcataccatcccaactgcattgctttcatttctctatgtttacttccagtcgttacccatatattataaaatatagttagtctttacatattttataccacatagtgatataatttttattccacctttatttatatttaacatttttgttgttttagcaataaagaaggaagcagcagacagactatttcaaagcttaatgtgtgtagttcccaaattgtatttgttttcttagtatttgttttcctagctatgataaaaatgaagatttaagggatggttactacatattaacacagactagtaacttaagtagatgtaatgaaattttttagagagctgggtgattctctaatttaaatacaagtttaaggacatgtaggatagttgaacataaaattgagctacaatctagaattactactaaataggcaattattttgttttggcaacatatatagaggcactaacaattacatatgtctacctagaaatgacagaaggaacacttgaaatatgaagcttactttattagctataagtgtgtttttctttaataaaacatactaacttacttgaaatttatttatacaaactcacttaactccatgttcattcttgttaaaggtagtatttcatttgattatgattagggactttatttaaatcactaaaatttcattcttcatttaatgatgcctaccaaaatatagagctgtctacattagcactgctcatttattacactaatttcccaaaatatacaagtttattctaaaagctcttcataaaaattacaaagaagtggctttttaatttcccaaagttctcatctggattagaacaaggttaggataaatttttagtgaatagaaccatgagcttattttaaaccacatattatctaaattatctttataactatgcaggcatatttcaacaatttctgtgagagttcatggactcttcagagataagagtttcttttggctctttaaaccatttgagtattgtggtgggttgaattgtgggtccctaaaagatgtctatcagaatctgtaaatgtgacctcatttggaataaaggtctttgtagatataattaaggaagagatctcaagatgagattattctaaaatagagtgggtcctaaatccagtgatcaatacccttagaagagacaggaaaagagagacaaatagaagacacagggagaagagaagaaggctatttgaggatggaggcagagattggagtgatgctgccacaagccaaagaatgccaggagccaccaggagccaccagaagctgggagaagcaaaggagaattctcccttagagctcttgtggggatcatggccctgccaacactttaatttcagacttctgacctccacattgtgagagaataaatttctgctgttttaagctagaaaatttgtgataattagttgcagcagctgtaggaaactaatacaagtatgcatttgacactaattacagattttgaattgctttaaatcttagtctacgactatcttgtgtttatagttaagagctttttaaaaaaagtatattaaggactgaatatctgtcataaaaacaatgttatatatgtattattccatttatcctcacaaggttactgttttggttttattttacctactgcagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaaggtaatgactcttacatttttctctcacacaatatacaaccatgctgatcggtgtctttggatgtagtatgaagatgcatgattggtattaggaaaatccaatatttgtgatgatcacatctcatgtaacatacccagaactcagccagtaaagtgaagttcactgaaggaggaatcattccttagtgaattcactgtctttggtagaatagatgtctgagacacagttatcatattaattgttttaatgggtattacattggttacatggatatgagtgctttaaaataatccattcttaggccaggtacctaagaatcacagtaacttacgtctgtaatcccagcactttgggaagctgaggcaggcagattgcttgagcccaggagtttgagaccagcctgggcaatgtgacaaaaccccgtctctacaaaaaaatacaaaaattagctgggcttggtgaagtgtccctgtagttctggctacttgggaggctgaggtgggaggatcatctgaacccggggaggtagaggctgcagtgagcagtgattgtgccactacacttcagcgtgggcaacagagtgagaccttgtctccaaataaataaattaaagaatccatttttccactaagtcaagtaacttgctctccagtggcctaagtgatgatcataatagtaaaatagtagccaaggcttacttaagctcttcccctgtgataagaatcataccacatactttatatgtgttgttatttaatcctcaccaccactgttattcatttcgttttacaaacaagaagcctgagtgaggcttacacagctgtcaagccacagtgtgctatgatttgaatccacctaatctgatgccagcatgcagatttcttaccttctgcccttccactacagtatcttcctgtataaatccctgccaagaccatgcatttggttcatatacttaagtacactaattactctttaaaaggataaagatgtaaaaatttagttggttgatatgcaaatattgctcatcaacttttcccaattctcacgtgtaactgtattgttacggaaaaaaataaaaattggtcactgtatttctttaagtcactttagaattatacatgtaatcagaatggatgatagtgaaacacagcatgaaaccataggtagctagtgagaaattaaaatgtagatatagatttagaaacatattgggtgtagatttatgatagataccctgagtcttacaaatgaaggatgaccgaagccaagattatcctgggaagagaaacttctcagatgttctctgagtgttggggactatgatgaacaccataagcacatttcaagaaaagcaaatacaatgttgttttttgtttttgttttgttttgttttgtgatttcccaaagtattatggttcattttccaaaatcccaagtttcaaatcacccactattttaataattgttacaacctttcacccacaccaccattgtcttttcacatctgaatctgagtttgagtagttattctaccatctatgtttgtggtacaaacgagttgtatttaaagagtgctttttgaattctagggctctctgtaagttacttcatcaggatcctgtttctttgatcaagtcagcatgggtgcctaccaaatcatttctactttgctgtgtagcttttaaatctattttctgggtcactgggcttactcatggaatttcttttccttagtttgtttctctactatagtcagagtaaaatgagatgaatggatctgtatttaaagtgtggcattttcccagaactgccatggcctttacattcattctcaagaagatcaagatgagcagaaatgatcttcacagaaccaacatttactccaaaggcatcaaaactctatttcctgaaatgcatttgagtcacttaccagcccagtgggatctctgtgcaacaatttgaatttatatcagtttacaaattcactgaaaagaattgtgtcttttttggttagttcattcctgaagtctccaggctctactgaataacccagttggtttatatataccatcaaacttgcctaaaccctagtcactgcacctggttatctggcctattaaatgcacagtcagtaattcagtttaattcagttgaattcagtcattaaaaactcatacttgacatgtttctttgtcaagggcaaaaagaagtcaagtaatcagtgaaggaggagagaatttccagtgattttctgttacattcagtcctttcccatacaattagtagaagtcacctggctccttttaacattttggattattttcatacccctgtcttgctaaagagagtactttagctaaaaagccatttttcttttctgagaataaaagagttgccctttaaagaatcttttaagaacaagtaagatttctgagtcagtgtttagagaaatgccacaacttctggatacctataggtagaaatataatgtattagatattgcctaacaaaggtagtcgattcaatattttcacatgaaactttatcttagcggtgatagaatgcaacaaatacatgtgaaaattgaaataaggctgagcacagtggctcacgcctgtaatcccagcactttgggagtccgaggtgggcagttcgcgaggttaggagatcgagaccatcctggctaacacggtgaaaccccatctctactaaaaatacacaaaaaattagccgggcgtggtggtgggtgcctgtagtcctagctactcgggaggctgaggcaggagaatggtgtgaacccaggaggcacagcttgcagtgagctgaaattgcgccactgcactccagcctaggcgacagagcaagactccgtctcaaaaaaaaaaaaaagaaagaaagaaaattgaaataaataatactgcactccagttaaccttccatgcttccatttgtgaccccagtttacaccttcctcagattacaggctttaaggaactttagagccaatacctctgttggcgaagaaagccaactacccccatctttctgaaactaaatcataataatgagagatgttcttccttgatatccaataatcttggaacatgaattgtagctatgagatgagccaagtcaatagatattattggcctgtgctctattttagaagaccattcttctctggtgaccagaaaacctttgaggttgcaaagagattggtctgttttcaaaagcattgagacttttgagttatgagaatctgttcattttgagaagtgaggttttttttccattcaaaggatttaaactaaggaatttctgatggatatgcctgcattgacaaatatgcaaaaggataattattttttatttattcaaggttcatttcactgccatgaaaataaatcttgtcagctatttcatggaacagaaagaacaaaaaaaagcaaggcaaggagttggagtgttgggggagaatagaagggaaaaagaataaaggtattatgttaatcatcatgttgcttagagggataaatgaaaagcatagaccagctgggctatgaagtgcactgatagagctgaaatagagacataccagagttatgatacagtaatgaagggaattgttttcattctcagattttgctttcctgtgcttactccactttatgtaagtagaagtcttgtgacctgttagaatgagagtgattttctgtctcactgttaagatactaatttttttttttctcctagcgacatgttggcaaaatctgtccttacaaactgagacattagtgtggtctgatggcttgcaatcctgactgtttattcacttgttctcaatagccctggggctggatggtgagattggaaactttgaagtgggcaaggaatttgatgccatcctgatcaaccccaaagcatccgactctcccattgacctgttttatggggacttttttggtgatatttctgaggtaagtaaaagaaagttaatcaaaaggcatttatttcataaagtcgtcataatagcttccctgtagaaaagaaaatagaaaccgaaactttttaatggaatgcaggaaaatcttaaaatggacgctagagccctttgataattattataattttatgacagcaatgttaagaataatggtgttaacaaaacttttatattttgaatgtgtttgtgtatttgaatgtatttggctacaaacagccataatgtaactagcactcattgaacacttgctatgtgctgggtaggcatgggattaggcacttccatacctaattttgttcgatcatcagagcaactctaagagagtaggtactattaatattgccatgttaatttataggggcagtgaggcttaaggaaggctaagtgatttacgtaaagactcatagccagtgattagtaggtagagtttggattcacacctgggactttctgactacgagaggcgaggctcttgagcactatgctatgtcaatgtttttaattttataagaaaatgaactttgtttctcttattataaaatgtttttctatggataaaataaactagttcatcttacctgaaaaataattccttgtaagatattgagttcttcctaaaaaaagaattaagtattgccatttctaaattgatctacttgtgagagtaattgcgataataaatatgttaaagattttaaaagaaaaattctgtattatatgaagtttgtaccatttgttattataaaagaggaaaaatatatttttctctacccatcttagggtcaaggctgaggtcactataacaagagacagatttaacaggagaaaggcatacacatttatttaatataaatttttttgagacggagttttgctcttgtcgcccaggctggagtgcaatggcatgatctcagctcactgcaaccactgcctcctgggttcaagcagctctcctgtctcagcctcccaggtagctgggattacaggcgcccaccaccacacccacctaatttttgtatttttggtagagacagggtttcaccatgttggccaagctggtcttgaactcctgacctcaggtaatccacctgccttggcctcccaaagtgttgggattataggcgtgagccactgtacccggcctatttaatataaattttatgtgacataggtgccttcataaggaagtgaagaacccaagaaacaggtaaacttggatatttttatgctaggtttgatgaagagtggaaagttgtagagaaatatgataggacaaagagtgtggtccagtggtaataagctagagagaacttagcaaggcctgcttgttcagattcttctctgtgatcctttagcttcagagatcaggtatagggagggcaccccttacgtgatggtcttatgacctgcattggggtaaggggtaaggggagggtcagagtgaccttcctgtgtttgatttgagggtagcgtgtcctgaccccctcattattttcatattgcttattcttttactctctgattagagtaaatttctaagaatagggctctagggaatagtcctagtgatttttcttatatcaggggtgtccaagggagttcttagtttctgtttcaggttgtgccagtaaagccccctccctcatccctcttttctgcttatcagtagagacagaaactaaaaaccatggcttcaggctgctaaaagcctaaaacaaaacataacaaaacagaacaacaacaacaaaataaggcaggttggatgagcttgtcttacatcatacccgtcttgaaatatttgaattattttactaaattaatttctttaatttatataataccttttctctgatgactcaaaattcacatacccagaactttcacacaataggtaaacttctgttaattgccagtgggttattttttgttctgggaggtttttataaagcacatagccacttcttttttaattaatagaagtagattttgccattgagaaacaaattcgtatttctgggctttgtcaaccactatcagctgtgaatttacttttctaaatgcacaaatgagtctttcttattacttttattttccattttaggctgttatccagaagttcctctatctaggtaggtagatgcatgtctctatgctaaatattaaatagaacctttccctgtctttttcttgggtatggctctatgtatttatcctaccatatattaaactctgtggatgataatttgctttgattcattatttttttaacagtctgaagcatcaagcccattggtggcacattatttaaaggttctatttgaaatgcacatgactccctctagtcataaattctaagctgaggaatggaaggccaaaggtgaagagatcttcatgttcaaccctcttgtactcattcggtatctgacatactgccctgccatgtttttgtgacaaatgtatagtagagtctcaccacacgtgctggtgatgtactcacattcaattccattcactgagagagagagaaacagtaatgcagaatattctacactgcctcccattctgttcagtgagcccaggactgagtgaactcaagatggaaagatgcatgtgttacttcttgtggagctgattctggagcgtaaagagtagtatttctttctcagtgggggcaaaatgtaaaccaaccacttcagctgagaaaggacagctatagggggttgattcaactttatgtgatttctgcctctggtgcagaattcagaccctaatcatcaaattagctatggcattttctactagtcatatcttcctgttcagattataaacaatctgagggttgggggaaagcagcttttagtatttcctctcctagaagtatctttaaaaaaaatctctcccaatggcaaggaagatacttattgacacaaaaggattttatacatgattccttgatttttctttcaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 260 - DNA, 102874 bp, Homo sapiens; identical to SEQ ID NO: 259

SEQ ID NO: 261 - DNA, 102874 bp, Homo sapiens; identical to SEQ ID NO: 259

SEQ ID NO: 262 - DNA, 148110 bp, Homo sapiens
ttcccatgttttcttttcactaattttatttatattaggtagttttcactcagaatatcaattcatttttcaggtttagatatatgtatatgtagctgttcgtatgcattaatcacttagaaactttatttggtataacttcacatttttggtatatagaaattttattttcttaatgcagcacagtagacatacaatcaatattattccctagaatgtgcaatatataaattattcacattaaaaaattaacagaaagcctcatatgcagtaaatatttaaaaatgtatatctaactttgattctgtttctgactatacactactagctttataaatctgaatgaatatgacatttacacatttgaatgaagtacacggatgggtccattccagatgcttattacaccgtatgaataatctgctcttcactttggtcattaaggttccatgtgctgaggcatatagtggatccgaaagacacttccaggaagtacatttattacattggcatcttaagaatttctgttccttttattctcctttatagcgagggggccttttctctttaaaagcaagaagaccttcaagtctgtcttttgttggaatggtctaagaaaaacaaaatattaaatatgtcaaaaatgttaaaacaactgtaaaagtttatcaagcactatctaagaaaactacttagaaccacattctaaaattttgaaatcagtcacctgaacaattctcctaattatgtaaccaaactcatccttcttactccaagtggtcctctaccccattttgctcttctttttctagtttcctaataaggtggaaggttattatcgatttagatattttctcttttctattatatacatccaatgctatttctatctaagcactgctttcagtatatcccacaaactttgagaagttgtattttcattttaattcaaaatactttataattcctcaagacatctctgacatataacattatttagaaggatgttgtttaatcacccaatattttgggtttttccagcagtctttcttttattgatttctagtttaattccattgtggtctgaagaataccttgaataatttctggtgtttacatttagtaagttgtaatttatggccaaatgtgcttttaaaatttttctttgggctctgaggctatttctaagacgtttgtaattcactttcctcatggcacgtactcatcaatgacaggtggtgatttatatatacaagctgggcacagagtcacactctagatactgctcctttaaacgagtgctcatgcagtttccaactcccaggaaaggtagaacaaaacttttttgctatttcagatgccctaaaacaaagttctatctttcagagaaagacaaaaaagggaaaacattttttttttcctctccaggaagacctaataatttgtatgcagtcatccctcagttatctgcaggggattggttacaggacctcctgcagatgccaaaatctgcagatgctcaagtcccttatatattaataaaattgcatatcatattacctacgcacatcctcctgtatactttaaatcatctctagattatttataatacctaatataatgtaaatggcatgtacacagttcttatactatattgttcagggaataataaggaaaaaagtcagtacatgttcagtacagatgcaaccatctttttttttcctgaatattttcaatttacacttggttgaatccacaaatgcaaaacttacagatgaaaagggccgactgtgtaaaaaataaaactataatttcattagtgaactttcagtggtcaggagagacagatcagaggttcaggaaaagccaagcagtctcaccccaggttgcatggcaggcacacgctcatcaccactctcctctacctctctacattgcagtgggaggccaggaccaatcccacaaaagaaagcataagcctagagagacagctcctgcacacccaggactgactcagttactctaagagttttctagattatatagacaagaggcattcctgtggaacagaatcagtcataagagctggtaacaaatagcagaaacaactaatttcaacccatttgtatgattttggaatgggcgcaagggtaatcttgctcagtgaaattcatttgaattatacagaaggtaaatataatttgtaagggtcatcctcattgaatttgtgattgcattacatacctgagcataacaagcttcttctatggctaaccctgttactaaatcgacctgagaataaaaacataatccatttcagcagaaataactttgcgaaatgtggtatattcaacagaaattcaaattgaataaccttatccccaaagcacccaatcctttgatatagtacagcagatcagagtgtgaccaacatgagacacagaaccaggcttcctgggttcgtcctgactccctcacttgggagctgagttaccttggggaagttatttaacctctctgtgcttcaaagaggcatgtctgaacaaggggctaattataatgctcaccaaatgggagtattgtgaggattaaatgagttaatctaggtgaggcctttatgtcgcgacacacacacacacacacacacacgatgcttaatacatagtaagggctatataaggtatttgctattggtattgttaccattatgtaaatatttaaataaaccaatcaaatacttttgcaaatttatgaaactgtatttactgttatacagtattgactgtataaagtcaatctctttttactgctatacagcccaggaagatgcggaggttccttagtctaccaagaaggaagcacttttcttcaaaatacccataagttacccaaaatataataactgccatgaaaagtccaataaatgggtatgtgcaccaccccctcctcccaggcctggggccttcactcttttggagtcatctccctggggtacccccaggacacacaatggattcaccttatacctgcattgcgtgtgcctccttgtagaaggcacactgagaagctaaaggtggaaagagctagctgttcttggaatgttttgtataatataatactgatgctaaaaatgcacagaatgccctgttattttggttttctatgaactactagccaataaatctgtctgttaactggatggcaagaataatgagcatgtcataagcttcagggcactggtaaaattactgaattctgtgcttgtgatactgaattagcaataactgtaagaatgaaataaatgacgtacttgcaaggaacttcagtagctttcagtaatagtagcatttaaacaaccatattttagaactttaaaaaaaatgtagaagtctaaacatggttcatttaaattaaatctccactctccattcccaaaacaaactcaagcattaaggaacctacctccatcccttgattaattgctaattttgccactctcattgcaacaggtccctaaaattcaaattaaagaaacagacttcaattattttttatgcaaattatgtcgtatatctcagtaaaattcagaattcccaccactggatccattgcacagccagcaatggctgtcagatactagatggaaaattttctgagccttgcaaggctgtaattaaagagcaactgcaacaaccacatcagcacattatttagattccacatgttttgttatgctgcaaactccggatccttaaaggtgagcaggtagtgcatgtccagctgtgagcttgctgttcttcagcaacacttcctagaagttaagtagaggaaggaaaaggaggtagtctttgcctcagtaccacaccaattaggggttttgaaagaagcttgggctggggatgaggctgttgctattgattaaggtagggttctgatatcatctccttcagacactggctatatttcctccattcgccttgacaactaacagcaatgatggtggattaatcaacagtgtcctctaagcagtgctcccacagcacacataaatatgaagtctacataagtctttcaggatgcagaagagtcacaaggaatgaactggatatctgttgtgagaaggagaatgttacctgtgtcttgcagaagccaaactcttaccaagcagaaaaaccagaatccctcagatggaatttcattattggatcacattttaaagtcctaaaataccatttatgggtaataaatgtgaattcaatgctatattttgaactgaatgctcttttgaattaaaacacaaggtaggctctaaacaacaggcacagcaaaggactcttggatggtgacatggataaatgcatgaaaagacatgttttcctatcaaggagtttctattattaaatttgacctatctaaattttcttccaaatcatgtttacaaatctttttcaaaggccacaatttccaaggctatagttgttagacaaatatcttattgataattcttcccactgtgatttgtatatatcatagacaccaccaccatttttttcatgataatcaatccattttattaaatggtgtgctcctctaatttttccattttcattgtcaactgaccaagaaaaggtgcttgtcaaactcctagatgcacacaaatccccatcctccttgttaaaatgcagatgtggactcagtgggtctgagatgggcctgagattctgcacgtctaacaagctgccaggagatgcccaggctgctggtccacagaccacactttgggaagtaaagtttagaaagccatgagaaaaacaggaaaattcaaaatgctattagaaatagtgcttgatttaatttgtttcctccttaaaacatttccagtgccttttcttctttacaagcctttttttctcagataaatggaagtaatatataatacagatatcacctagaaatactgattttacaaaagctttcagttatctggaggactaatcatttggcaacaaagtaacaaacataaaaataaaggtgattccactcaaacttcatttggtgactcgtgcatgtaattttgcagtcacatattttctgaagtaactcaacatcttcttatacatcaacatcttcttatttgtttgacctggaggaaaattaattttaacaatcaacattctgaaggagtgtccttccaatgaaaggtgacaaaggcacatgcacagggactgtgatgacggctgggtaaccacacaatgggatgcggctcgacacactggcagtggaaggagggagcagaggagaggacagtgctcacgttctcaggcggggcggtgtgtggacggtggtggcatttgctgcatggtggccacagaagcatcatgggagagagagcaagtcaggccctaaggggctaataagctgcctatagggagctctgaagtagagagctgaacatccatgtcaggaggccaggagcgggctctgcagatcatcagaattggaactgtgtcataacctttcttaaacacacccctttctttcaactgaggtatgttctggtcataaagttttaagccaaggtaagttataacaccaatattcagtcagattatactctcctgatacttgtacctttaatttgtctttaggtagagacttctctcatatttgggaagaataaataagtttgtagtgagaatcttatctttttaaggcaaaaatctttttttatttgctctgtttccatcaatccaacaaatacttattgagcatctactgaatgtatggctctgcactaccttatgtggggaataaattatataatggtccttccctaaaagagctaacagctcctaagttaattaagaaggaccagaagcatcaatgccaggcagtgtggttttaaaaaccgattcagcaggtgcataccagcagagtggggactggtttgtcagcaaaggctcctgtgctgagtgccaagaacactttctgaaactggatgcaagactctgaacaaatgtgagcattcatgcatttttaaaaagaatcaaatgcatgaatttggaatctcatggcattcccaaaaagatccacagcccacaaaaaaggttatgaaacctgtttgagttaagcaaccctgagttagagagaaaaattattttgactctagaaatggttagggggttataaaacttcaaactccactaggaataaagaagatcactactgcttacacagcaaaagaagactctttctctcaatttaaagccctttaatcttgtgatttcagaccaaaggcatatttgaaaaatatatctgaacgggtgacaaaaagaattgcttaaagcaggactgtcagtgcacggccactgatatcactcctgagtcagccatacgcatcatgttctagatttgaaagtgtagttgtgaggaagcacaatggagtcaaaacaacgcctacaccaccataggcaaacacacagaaagacaaacaactgctgcttttcaagcaggcttttcacttttcaagtgaagccactgcaatggaagtccactctggcacaacagactacagtcccttactagaaaacagcatatttcaatgtattttgacttggggtggcccagtgtgacagccagccctatcactctttctttccatggctatggcttccattagagtgctcagctggtgagcaaattaaaacaccttgctaggaagttgtgcacatgtgacaagcattgtcaagggatattttatcaaagtgtggctacaataagacccttggagcatcttcaaagcgtcatcagaattccacaggatcatagtgtttatcttgtgtaactgctctagttttacagagcccacgcatccctttacttggaagcaagccagggacttcttccataggcaagatgactgctgttttagtcaaagtgttataatgtttcctaaaatgagaaaaaataaactcatttaatgagaaatacctgaggtaaaaactctctcgccaggtccaaggccttcctgtaggccgcgtctccctcctggttctgttccagaacgtggctgattaagcccactgctttggcttctttgccatcgaggactcgcgcagagaatatgagctccttggccagggacattccaatggcgcgtggcaatcgctgtgtcccccctgaggggtgaaagagagagaaaaggcaatgatttgacacctgttagttttaacacttcagtgtttcatatcttcatttataaaaataaaccagggccagaagtttatatgttaaaattagtagctggaaaactacttcagaacagaatctaatttcttaattcccctataaaactaataacaccaaaaaaggacttgagaaccttacatccttattaagtgattttggcactgagtatcacctgcaacctctctggtatacactgagtccaatccacagtcatcaccccatcagtaaccatcaggtgaacagcagtggataggcagtaccagccagtaagtccactgactagaaaggcagagttccaccaagcttggcattcttctttcagcttaaataaatcttaacacattgtgagacattcaactcctgttcttttaaagaatcctttatggcgaatacattgtaaacacattttaatctagaaataaaaccagacaatgactcatgaaaacaggctttgtcctggtggtattttctcagtgcaagtcctggtcatctccgttagctcttctctcggagacgctctctcacacaaacacaccccttttccagctggtgaggaaaatccactgtgtgtggagtcagaagccatgcatttggttttgacgttgtcacttactactttagggacttcgggagttcattaactcttcaactccaagggaaaacagtgggtatattagcatgatttagggtaaatgtaggtcagaatagttctacagcaaaagatgcttattttgttgaagatagcctaactcactagatccatctatgtattcacttcagtatcttccagtgatgaggacgggatctcattaaatacaaagttgggcaaaagcaggtaacacaggtctagcctcaatgtctaccaagaagaaatgaaaacagcttcaacatcagcattcacctaaatctcaccctatcaatggctgtgccaagaggcagaggagcagcagactgcccccttgcagagcaggaaaagcaaactgacgcccaccatctacacaagttcactgggttttacttgacctacaaaatttaaaacttttctttctgcattagttagcaacatttaaaactagatgagtgattttatcttaaaaaaaaaaccaatttacctccagtatttttcctttaaaggaaagcaaaatcattttttgttcacacctctatgaaaagtggaaaaaaattaaagaccacaagaaggcacatgtttaacaaagtatgcctcagttggaagaacagagcttaagatgccattattaagcaaaccatgttaagaaccgtaattaatatttagaacacaggtaacacttagaaaaagaaaccctgaatgaattgtaaaaggactaatattttcaatacagactgttttcaaacaaatacaataatgctaccgcaaaatgcagttattacgtgtttaagctgcccaagccgttagagatggtgagtttatataagtgtttactcgatacggcagaaaatatgtgtctgaagacaatgaattattgacaaatttaaatttaactttcgacaatgatgttgctcagtgtagtaaagataggtctgagaacttacgggataagctgcatggaaaagacaagctatttatggtgcttccaatggcagctgattagaacacagatataaatataactcagataactatatttactcatggagctgatgagaattttgatgagactgaagaacttaatgaatatatattattcatgataagcatattaggaaatggttctttctcatgttctatgaaaagtttaatgtagactggtcacaattaacaaatgtgacccacattgttaatgtcacactttttattcaacagaaacaacattttccaagtcccggaagctcaaactcgttcatcatattgttccacttatagcatgatcctgaggtatgaggatttttgcagaaacttaacaaagtaatggtcatgtaggtggtaactaacactaggaaaaagacccagtcccttaagctgaggggtagacagctggatgctttgtttcttaagctggatgcataacacaacagatggctggcgggcctgcggtggaggctagaggtatggtgcagaagagagctaactttctgacccattgaaaacaatgcatcacaggaaccaggggaaaacccttggcgtggctcacccactaacactgcatccaggacttgatctttttggatgacatcacaagccatctactttattgcctcatataaatggaatcgttcagtatttgtctttctgtgattcacctgtttcacttagcgtaatgtcctcaagattcacctctgttgtagcatgtgtcagaaatccattcctttttaaggctgaataacattccattgtacgtatataccacattttgcttatccattcacccctggaaggatacctgggttgctctaccttttggctattgtgaataatgctgctatgaacatggatatacaaatatctcttcaagaccctgctttcaattctgctttcaatatatacagcgtgggactgctggatcatacagtaattccagtttaattttttgagaaatcaccataatgttttccatagtcaccaaaccattttacattcctaccaacagagaacaagaattccaatttctctacaccctcaccaacacttactatttttttttatagtagccatcctaatgggtgtgcagtagcattttgaaacccacccaatagtcccatagacagttctttttggataaacaaagaaattgacccttctgctgttaaagtttgaaacttgcatctgttttgagtttcttccccagaaaaggaccttcaggcctttcaaaaaaagtatcaaagaaccaaaactcagctgatcaccagaccagatgactccttgcccctccctagttcttgttttcttacacattgttacatttcttccctgctatataaacccctagttttagtgggttagggagatgaatttgaggctgagctcccatctcagcagcagcagccgattaaagccttcttccttggcaatacttgtcgtgacagtgatgggctttctgtgcagtgaacaggaggacctagacaaaacccctggtgttttggtagcaatttcattgtgagtagtcatgctgagcgcctaagttttcatgtgcttattggccatccatatattgtctttggagaaatgtctatttaaagttatttgcctatttttaatttgcgtcttgagttgtttcatttgttgagttacaggagttctttatatattctggatattaatcctttatcagatatagacttgcaaatattttctcccatcccatgggttgccttttcactctgttgatagtgcctgatgcataaaagtctttaattttggtccaatttacctcttttttctcttgttgcctgtgttactggtgtcatatccaagaaattattgccaaatccaatgttataaagctttttctttatgctttcttctaagagttgtatacttttagttcttatgctatggtctttgatcagttttgtgttaatttttgcatagggtataaagtattcctaacactatttcctgaaagggacattcttaaatgattacacaaatacatgatttcattcactcattcccactgaaattttaacttttagaacatttgtttggcaagaaattatcccagtttgcagaaatctaagactgatggcctgaattatatatatttttacatgtgtgaaactgaaagtaaactgtcccctccacccctcaggcatacaaaattcatgatttcaaggtttataaaaatgatataatctgttcagtctgcctttctcaattactaatgatactatgagcaaagaactttacaaatggaagttacaatgcaatattggacaactaaacatgattgatatggaatctaagatttttacaaatatctccggaatagttaccccaaatggcaaaactttttatgccaacattcttttccagcttgaaagtacttaaatttatgaacacgcattttctataattaaactaaatgaaactcagtattcttgctggttaaggaagtcaaatagtgcagaaaaacatcccaatccaaaagatgagatgtgccaaaatcttggtgcaatcatagctcactgtagcatccacctcctaggctcaaatgatccttctgcctcagcctccctagttagcatgccatgcctggcatcagactgtaagctccaaatgtaaagaggagaactagaaaaaaattacttcagttcaccttttcttaattctgaatatcaaactccaatattaacttagagttaggggtaaaagtgaagatagcgtatcctatttctgtcagttgactattttacaccaggcttgcttcattagattagatgatataatctgctagttcccttaggcatctgaattcaggattcctaaagtgccagttctttttttttattattattattattatactttaagttttagggtacatgtgcacattgtgcaggttagttacatatgtatgtatacatgtgccatgctggtgtgctgcacccactaactcgtcatctagcattaggtatatctcccactgctatccctcccccctccccccaccacaccacagtccccagagtgtgattgttccccttcctgtgtccacgtggtctcattgttcaattcccacctatgagtgagaatatgcggtgtttggttttttgttcttgggatagtttactgagaatgacgatttccaatttcatccatgtccctaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcccatttctccacatcctctccagcacctgttgtttcctgactttttaatgatcgccattctaactggtgtaagatggtatctcattgtggttctgatttgcatttctctgacggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggaatgacttggcaatgcgggctcttttttggttccatatgaactttaaagtagtttctcccaattctgtaaagaaaggcattggtagcttgatggggatggcattgaatctgtaaattaccttgggcagtatggccattttcacgatattgattcttcctacccatgagcatggaatgttcttccatttgtttgtgtcctcgtttatttccttgagcagcggtttgtagttctccttgaagaggtcgttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagcttttagcatgaagcattgttgaattttgtcaaaggccttttctgcatctattgagataatcatgtggtttttgtctttggctctgtttatgtgctggattacatttattgatttgcgtatattgaaccagccttgcatcccagggatgaagcccacttgatcatggtggataagctttttgatgtgctgctggatttggtttgccagtattttattgaggatttttgcatccatgttcatcaaggatattggtctaaaattctcttttttggttgtgtgtctgcccggctttggtatcagaatgatgctggcctcagaaaatgagttagggaggattccctctttttctattgattggcatagtttcagaaggaatggtaccagttcctccttgtacctctggtagaattcggctgtgaatccatctggtcctggactctttttggttggtaagctattgattattgccacaatttcacatcctgttattggtctattcagagattcaacttcttcgtggtttagtcttggaagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttcaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatatctgccttcatttcgttatgtacccagtagtcatttaggagcaggttgttcagtttccatgtagttgagcagttttgagtgagattcttaatcctgagttctagtttgattgcactgtggtctgagagacagtttgttttaatttctgttattttacatttgctgaggagagctttacttccaagaatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggcttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttggttgatgcagtttcttcctagtctcgatggtctttacattttggcatgattttgcaagcggctggtaccagttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagattcgctgttaagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttcttttttctctaaactttccttctcgcttcatttcattcatttcatcttccattgctgataccttttcttccagttgatcgcagcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatctgatcgtctgaagccttcttctctcagctcgtcaaagtcattctccgtccagctttgttccgttgctggtgaggagctgcgttcctttggaggaggagaggcactctgatttttagagtttccagtttttctgttcagttttttccccatctttgtggttttatctacttttggtctttgatgatggtgatgtacagatgggtttttggtgtggatgtcctttctgtttgttagttttccttctaacagacaggaccctcagctgcaggtctgttggagaaccctgcagtgtgaggtatcagtgtgcccctgctggagggtgcctcccagttaggctgctcggggctcaggggtcacggacccacttgaggaggcagtctgcccgttctccgatctccagctgcctactgggagaaccactgctctcttcaaagctgtcagacagggacatttaagtctgcagaggttactgctgtctttttgtctgtgccctgcccccagaggtggagcctacagaggcacgcaggcctccttgagctgtggtgggctctacccagttcaagcttcccggctgctttgtttacctaagcaagcctgggcaatggtgggtgcccctcccccagcctcggtgctgccttgcagtttgatctcagactgctgtgctagcaatcagcgagactccatggggtaggaccctccgagccaggtgcgggatataatctcgtggtgcgccgttttttaagcccgtcggaaaagcgcagtattcgggtcgggtgggagtgacccgattttccaggtgccgtcggtcacccctttctttgattaggaaaggcaactccctgacctcttgcacttcccaagtgaggcaatgcctcgccctgcttcggctcacacacggtgcgcgcacccactgacctgcgcccactgtctggcactccctagtgagatgaacctggtaccacagatggaaatgcagaaatcacccgtcttctgcgtagctcaggctgggagctgtagaccggagctgttcctattcggtcatctaaagtgccacttctaaacagtcttggtgactgatgacattaagcagtggaattaaaaaaataggattgtccttggtgaaattataattgtttcagtctcacaagcagccctaatgcattcaaggtgacagaggtctacaaaactattcaaactcacactgtccatcccaacagcttccaatgcagagcctgactcctggtcaggatctgctctgaggctccctgggctggagctatatactcagggattacgacatcagcaagtaacacattcccaggacactcctgcagatactccatagtactacagagtatgaggagaaatgtgaagataagctgaaaattacaggatagctcacaaggcttccactaaaaaacaaagatctcacagcgaccacagttaataatagtatgtacttatatgattttgaatgttcttaccacacaaaaaaagataagttggtgaagtcgtggatatgttaattagcttgattgactctttctacaatgtttacatagatcaatacactatggccaggcatggtggtggctcacacctgtaatcccagcactttaggaggctggggcagggggatagcttgagcccaggagtttgagaccagcctggccaacgtaacaagactctgtctctaccacacatagagatacaaaatcagccaggcatcgcatgctgactacggaggctgaggcaggaggattatttgagcctaggaagtggatgctacagtgagctatgattatgccactgcagtccagcctgggtgacagagcgagatctgtctctaaaaatataaaaatgaaaacaaaattatcacattgtgccccataaatatacaattatttgtcagttaaaaataaattttaaaaaacaagtgcctcaaaccttcctaggggtagtaaatttatagcacttttccttccacagaaaagcaactataatatttctgccatttcaacaccccaccagccaaaggtactatgtgaagtttcgtgtacctacatgacgctatgtccagatcagcaagcagaaactgagttccaaagctgcattactatgctatgaagaaagaaagcgccttggccactgcccttccctttctaatgtgtgaatgcttagaatatacaaggggatttctaaggctttttgccttggctgtgtcaacttggaggttctgattcagtgagtatgaggtgaacctaaggttctgcatttctaataggctccaacattcagctgaagaggcagcagaatctactaacccactgctctaaaacaggaggtggagagataattctcttaaattaaagcaacagaatttacataaccaagtaagtaattgcaatcatcacctcacatgctgtctacttgttgtttaggaccattttggaattcctcctttaaaactaatttcacagatgacaacccattttttcactcattgaagcatcactatggagggaccctgttttggtacatggatacatccatgaacaaaacaaagcccctggcccctggcgttcaacactgtcatgggaagcctcgcaataaagaaagaaatacacacagagagtaagaaagcggggggagatggagtggggatgggcacagttaagacaggatggccagggaagggctctgagcaggtgacactggagctgaggcaggaggtagcaaggattcccacacaggtctggggaatgcatctccaggaggaacacgaagggcacaggttttgtgggaattgcaactgattcacttgtggagcacaaggaggtccagtgtggctgaagtgcacagcaggggcagatcctgtgggtcccatgggcccaaaaggacctggggtttactctgagggggacaagaagccactgaacatctgagagcatcttctgagaaacagtggtatgggactgtcattctctaatgaagatttgagcttgtcaacctaaataaaaaacagggagagggcctctaaaaggaatctgggaataaagcattgcaacaggaatgcgtatgccataaacaatgtgtatattcagggagataaaggaagacaaaggtttttagaggaaaaaatgaagattacgtaactgtttcaaaataattatccttggctacaaagatcaataacaagtaacgccagcctgaggctggacaggcagttgaacagacatccttgcagaagtgtcttctgtataaggttacaatggccttcatgtaaggttgtggtttttgcagagtgttttgtgatggttttagttatcaggcatacaagcataagaaccctcttttcatgggcttctcaattctatttgtcagggttatttttaacaccagtgattccattttgattcctcagagatttgagggagaattatggtcatgaactaagaagacgggggtaggcagatgtttgtactatttgtggtggagctccaacaagctcagagagagacttctaaacaagttccccaaatgatttgaatgttggccatgttttggctgctcaacatccactgcccccattaaaatcccggtcttgcttttggagacccctttggccacccctctctccactgtatcagccttggacagtagaggatccctgcaactgaagcccaagagccagagctgcctcctctgccctgacacagctggacaggcgtctacatcaggtctggcctgctggatgctgcttccaggactgacagtctgaatgggcaacctcatggcatggagatttgccaagctcacaaagagcacagggcagtgacgtgcagacctgccatggtatagactgtctagttctggggctcctgggttccagtttgtgctctaagcttcaatctctatccatctattgatttcaggagacttacaataaatttccttttcatttagggtagccagagtcaatttctattgcttactctccaaaaagacgaatcatacaataatagagctattagttttctttctctttaaaaaagtcagatgaaactgaatgggagtttatccgttttactttttccaaataaagcttatttaagttcaataaataatttattgattaacctaacaagtgccaggcactgtcctaggtgctgaacccacagtgctgagtaagatagaccattccttaccattctgcagaaggagagcaaagacaaatggcaagaagcaatgggccagagagaagagactgtgaggagtgttacacagagaatttcaggcagggaagagagttctgagacagcacactagatgactaatttagattgggtggttggagaaggcctgcttgataaaggtgaggccaatgtctgaaatataaccagacatccaaatgaagatcaggaagaacacccagtgatgagctcagctggtacaaagatgtaaagatgaggcagagtatggcccattgaaggagaccactgtggctcataggaaaggatgtgaggaggagcaggacaggagcttgggtaagcggagtagaagtttacattttaccctaggcaaagtgacacaaaggcactggaggattttgagcagcaagtgacataatttgatctgcactttaaaaagatcatttgtaagattgggggagaagagatgataggggcaaaatcagaacagggtgcccagtaggcagctactgctgtcacccaagtacaacaggatggcagcttggaccgagacagcgcaaggtagggagagagatgtggaggacttggaataagtgttgtctgaaatgctagttaaatggatgctgggagaaaggaaaatcaatctaatggctagatttttagcctgagtgtgtgagtgtccgatattatgaacactgacaagaatggaggagggggaagctgtgctctggccaaggtaagtataatgtatcttttacacataagagtggagcagtcatgtgtgagactggacacagagaataaggtttaccaatgattagtatcatacaggtagcattcaaaaccaaggtcctgaataagatcacttagggagactgtttagacaaatgtcagcaagacctggacaggtgctcactgaggctgttcagctgctcaggtgcagccaaccacattttataagtcacctgttcctgttctaccactattcaccctacccttccttcaataaagctatgtctgcaggggtcttctaggaaagatattcttcactgaaataaagacattcaggaatacacaggtcttcttccaggatgctgtcacctctaaatgtgatacttagagctatggcagccaccttgtgaccatgatggaaggtggcaagggcaaagtctccaaactgaagatggcacagcagaaagacagcactaggctgctgaccttatcaatcctgaagacgccttactctgtgactgcttgtgatgctacagagtattttcttattgtttaagccagctgaaatagggtttcctgtaatttgtaccaagaacatcaggaagtacagatggatggaggaaagagatttgaacatgcatttcagaaagtggaaaagcaaacatactagggaagtatggcagtgttgctgggcaaaattaactacacacttgagatgtgtgatcaggagatgagttagcatgattattttttccatccctagcaatttctagctaactggtggcaggggttggggggatcggggtgggggtctggaactttgccagacaagtacaagaagagaggagagagctcagtaataccaaccgttgacattactgagcagatactacataacactacgtaaatcctcccaagtactccaagagtattcactcatttaatccttacaattcccctatgaggttagtgggaaggtagctaaggtcatttgtaagaaagtgattatcacaaagaaccatgaaatctaggctgtgtgaggagagaagagaggaaaagagggaaatgattgagagtgagtggccccagacctgaggacttagtgaggtctgaacagaactggaaggttaggatgctgcagagtgagaggcaggaaatcgagattcagaacagagcaggtgtgcataactggaggttgtggggtgactgggctgaatgggaaggaggaagagatccctgcaggtgcagtcacagactgctaaaattcagctcatggacagtatgagacaatgtatagataatgctcatcatggtttctggaataaattttctgtgttttaaaagccactgaaaagcaaatatttgaatactgagaacccatcatttttaaataggaaaaatagtaatttattcttagcccacccaaaagctccaatcaatttccccacaaatcgataaaatggcaggaaaaaaaaccccataaactgctatgtaacagtctaccacaatttctacataatatttagcattttaaacaccaattacctacttattgaattcttaatgaattatttaggggatacgtgtatgtgcagaaaatgaatctatcagctacagattatgtttcctcctatgtggcattaaacagataatgtgatgaaaataaacaataagctatgttataggtaaaagatgaatgccaataatgcttagcaaaattaacaaagaatttcaaaactgtttacttatcaaatgaaaagtctggtggtacaggagggagagagagaggcaagagtcactgctgctccctggtgatgcggtaaagctgtgtgccggggcaggagtgagaactgttcacactcaaatgaatttctttcgttggtactcaagatcctgggagtgaatggctttgactcactgtctgaagccacagacaaagtaagaggataaaaacactcaaaatggatatctttgtttcttttgcttgtgatctgtaaataatattaaaatgagtttctagtttataagcggttgactcttttcatttattcactagttttcaaaattacaaggtggttccctagtatcctctaacgctgaacagttaagtttttaatctttggaaatcataattaacttatagattttagcctatttgatgtatgacaacccactgcagttaaaatctttattgatgctcaaactaccccatctttgaccagtgaggacttagttagattggctgtgaagtccttttgacatgaccaaaatagtcatcaataacttcctgttacctggtatcacaaaatgttccaagctcatcttgtacctttcctcctcagaccttgattccttttagtggagctacatttttaaatgtaacgcttttgctcacatcatgatcaagtttatttacaatagcaatgatttcatatggtatgttctgaattcttttaaagattttgcattgagattcaaagcttctcttttctaacaaatgacgagcactgaggatgagcattaccaagggagtatggggaatgagttttttgctagtcagtacttcactacatgggctactggattgccaacattttcagtgtccgttttatactaattttattgctttgatttaaccactttcttgaaagcttaaaagtcagaaacaaaattttgggaccagttttttcagggttgcataaatatcacaaatgaccactgttagaaaccaggttccctcaatgtttctcatttgtcattctcaggctgcatcttctgtcctttcagattatctcatggtccaaaaaggctgctgaagccttgcaatcaggtctgcaaaccaaatagcaggaagggaaaagggggaatgggaagggagtgctccattttcaaagccactgactaagtactggacaacagtatctgtttgcatctcactgcctagaacttggccatgtgtagctggaggaggctgggaaatgtagtttccttgctgagtgttttgccatagcatagagaataaaactgggactctctcactaagggaaaatgaaaatgggtaggcaattagcagacactaccacaagtggcaaaactgttttcatcatgcaacaaaatgtcttcatgttcatgtatcacttggatagaataaagatatacttgaaatgtaatattactgtttattatttttccttcatttaatctttttgagaagacatcaagaatttttctccctaggtaataatctcctgcgattatactacttaaaacacaacttactttgaggtagcaacctgtcttagcagaggcttaaagcacagcaagcttttgccagagaaggcaagaagtaaaatgtttaaaatatctggttatctcctgtattccctgctgcctcttgggagccatgagaaccttcaatgccatggggagatgttggcagcaatctgagactactctcccctttcctccaagaccaaaagacctaaattcaaagtacagaataatgtgaaatatagatgttacttccccctttttatatttacatgtattaaaataatctaaagcaagctttgacatttcacattcaattacaatgtaatgtgtaaagaactgaccataccttatgactttggattataaagtatgttttagtaacatttaacggtggaaaacccaagctttttgttctgttttttttttttatccttcatcttttcccttctcaagagagcacaaagaaagaagtcatactgataaagggggatgctcataacaaatcttccaagttaaaagtatgtggataccaaattgagggcatttactgatatgcttagaagtgatctctgacttctgatagtaaataccacttttgaattacttataaatcttctctcataaatagaaaagccccacttcaggttgttttttccttgaaccatgggaggaaacactgcagtataatgctaactttggattataaagcccactgcaagctgattcctgtgggactctgtgtcagatggcctaggcaagagctttcttcatgcatcagggcttgatgcttacaaaactaacttcctctcactttacaatgaaagcatcagggttaaagaggagtgagctatgtgaacaaacatggcatgtttactagtcttaaattgtgtcacaatcatacaaaaaccataaaaatatttatccttccatttgtgaccaatgtttaaagtgttgtaatgcttcctattcactgaggcctgttgtaaagcaatgaaaacacacacgcacacacacacatgcacacacgcacgcacaagacagagggctatgtaaggagaaaaacctaactggctcaaccccagcagaacctgcctgaagcatattagtttgagctctttgtggattatggtagagaagcctttagcaatcaggactggaatggggaaggaaggctggacagcaaaaacgtttttccagagcaaattaagcaaactggccacaattaaacacttttgtgatacagctttcattaatatttattatagaaagctttttcaactattatgccacacactgttagagaaacatacacacccaagtcttaatcattaaaaacaaaattacgcttatttttcaatgtttacatgcacctttaaaaacaaatatttgctgatacattgtgatatctttttaaaaaaaattttgaagatgtattgttacctaccagaggaacacaaaatcttcctttcaaaatcttttatttaaagactgccatggtgtgcatctgtccattcttggccagctcccaccaatagcactgtgcacccctccgcctttgagtgctgtcttgaggctgtgaactcagatgcttgccctggtggctctgagaggtctctggaggcttctcctgcccaaccctcactcacacccatatgaccaagacgtgagcacatgactcaagtcagaccaatcaactctctctccttcagcgtggatcttgaacagagcaatggaaggaatggctgggctagtaaattggagtgaaggcctccaggtaaggctatctggagctgtacttccagggagaagtttctgtgatggtggaaagggtttgtgtttgcactatgtaatacagaagtcactagccacatgtggctactgaacacttgaaatgtgactagtatggctcaagttttaatttttagttcattctgatcaatttaaatttaaatcattgcatgtggttagtggctacaatactagatggcacaggtctagagtctcctgccactgagagagtctctgggggccctttagcctcccatgagctcccttttggtggtaacactggtttctgttcaaaaccaaagaaacttgacatgacctacagttcatttcaacatgcccaatgtcttagtcaatgatgcagctgagggagaaggtctacacaacatctctacagttcatggccagggtaggaggatgctgcacagcacaaagtgggaaaacagccagctgatgcctagcgataagtgcgttctgtggtctagacaacctgggtcacacaaaagtgacctaagaaggaagacattcagaatctaaatgataatcttacaatacagttgctcaacatacacaagagaagtggtatcggccagcctgatctaaactgagatcttcccaacagacttctgaacataacacctatcccaggtacatggaaactgtccagagaaacaaaactaatagaaagaggggatccaatggactcttctgtagcagcatacatgtatcagatcaattactagggctgcagtaagacatctacctacctacagtaaaaatatcatgccataacatgcctaaccaactatgtcttacatgtgttgcactttttcattctaatccctagttatttatatagacaatatgttatatattatatataagtatatgtgattgatttaaagtcatattagtatctacaaatgtattataaggattatggctaggctggatattttttcctttttgagattttgtgttaggttttcctttattaggttttgtggtaagtacataatatgtattatgtatgtgtaatacatatatacttgtgtcaaatgaacatgaatacataagccagccctaaagaaaagtcttgattacattattttaatgcagtaacatttgccagagatataatgtttcatgtttaccttactagacaaatcatgtaactactaaagcaaaatgtcaaacttaataccttgatatctacagattccaccccttaagagttgtatttaacattttatactttaaaaaaaaatcaaactctcttaaatggtgaaaacaaatcaactatgtaatatttcctagcccaactggacactgaatatggtaaagcataaaccatgtagtctgtttaagaaagaaactatgtcatcatgtctaatgatttaaataatagttatttattgtgcactacaagttactctaaaactcagtggtttaaaacaaacacttactctttgatagattctaaggggtcaggaatccaggaagagcttggctggctctcctgcttccaggctcccttccccacggctggcaggccttctcggtcctgcacacataagctacattgcagggctgcctcttgacaaggcattgccagggcgagtgagtcaaggaagccatagtctttttacaacctatctgagaggtgacgtcccattgcttctaagtcaacatggccagcctcactccacaggcagcattacactgtgtgaacaccaggcagtcaggttagaggctgcctaccatgaggacaaagattgatcaagcagcacacactgtaaggagcatcttttcttccactcatctttcttttaccaaaaaaccccagtatttttcaagacaacattcagagagtatttcccaaagttcaaaatcatccctcattctttccaaatcaaggaggaagtaaaaaagaatatgtgaaccacttatcttgaaaaaataatagaggaggaaaagtgtggagagaatactatggaaaacaatccttttggaaagctcaacacatgaaaaacacaccgtacttgccaaccacagtcagaagtgaaggaagtgacaccctcacatcaaccgtttttcttgtgtttctgaattaactgtaataactgtaacaataaagagtgaacactccatttcataaaaactgaactttcatgttttcattaaatgagggttctaataaaagacttaagatgtaagtgagaaatccttactaactgcatgttagaaacacaaaacatctggctaagtttaccaggtgttatcagatagtaaaatatcaggaataaaagaaataatatgtgaaaatatttcatgttacctagaaatgaccaaagaatggagtggacatgaagacaagaatgtttctgatattctttatcaaaagtagggcacatgatgaaaatttaaagattctgggcatagcaacaccattattaacaggtaaataactaccacgtattgagaacttactaggtactatgtaatggaatacattactcttataatgtttcaaagaatcctatgaggtcactatcataattatcttcatttgacaaatctgaaaactgaaggctcagagcagtaaggtggccaccagatccatatgcactagtaaatcagtggtggattagctatgtctcattctgcaagtcacctgcttttcctaacagtcagctacctaccactaacagagaccagaaacctgagacccatagctccttagctatctttgccagggctaagcctcagcgagacttaataagcatacgaatataactgggtaatcagaacaaaaggaaaaatgaattattacctatctcatctgttatcagaggcagtgacaatggcagaaagcttcaaaacaaaatcacacagcagtcagctccggttgggcaggtgttgctggagagaaatgaattacacggcaaggcccgtgtgatggaagggtgcacaacactctgcctcctcacttcgctgcagatcttcctcctcgctttctattctctgtgctggcccacctcaatcttatcttgcagtttttagggctagtgctacaagaaaaggcctgagacgtgaaagatgtggaactgaccacaaagcacagaacctgtgcagaggggcctgagccgatgtgtcatgtgtcccaccctgcaccttctggggtctcctgctggagatcagcccgggtggagcagcccacttttttttttctttgtaacctttaacagaaaacgagcagcaaaatgagcaaattaaaacaagcaggatatttgactataactaaagctataaaggtgaactagatagctttactcttcatcgggaaaatcatcaaacactctgtaaaaggacagcattagaagattttgttatttaacgaactagtcaacaactgtttcatattaagaaagtggaatgagccattcttcttagcatagcaaagaaactctaacttactggaaacaaattatattataaaacatatccaacatccagtcagtttttcaaaactctaagacatatctcaagaaaaacaaaacaaaaccaaacgatctttccctcccatcccaaacaaaagtaaaatcaaggcataccataaaacaactaaaatctctatctaaaccagcaagaaaaactacccacaacatataaaatgaatgtattcaccaacaactattgcttctttaggttcagttgggtaatttataaaaatcatccaatatttgtaaaaggttcactgtatagtattaatagaatatcagttaaaataacattggccaaagctgtcataataaaatgttgggggataacttcacaaaattggccacctgtagacttcctagttactgaatttgcacataaacttaatgtagtcagttatattaaactgaatataaacttaagctgcaagtttaataaacatgttttaacaaattttttagttttcatatttcaaaacattttaaggcacagctagaggtaagatacatttgaaattcatataaatgttgacactttttccttcccatccacatctcccaactagcttcctacaggcactgttaagtatgttggtaaggaaggtcagtgacttcctttcactccgcttaccagtgtcctgagggttctaaacccacaatggcaggttccagagggggcaatccctgtcctgtatcctgttccaggagaatgtgtgaagggaagttctagacatgacgagtattaattactgctctcctagcaagaaccatcaaagtattgtcactgtacaaaatatggtttatggcaacaatggatttaccaaggtgcacctctgaaaaattatttgagatgcagaggttaaaggttaaaagtaagccatactgtcagtattttaaatgaaaaattctttaaacactgaaaacaaaatatgcattgattacaaatttaaaatgtatattgcagatttctctatttagctagctcacaactaattcctagacaccctctttgaactcaatcagagcaacaacaattagttgaataaccagagagggaagggatgagaggtggggaggaaaaaagcaacgagagaggaagtgacacagttgcatggcacaagcatgaagagcagggctgggagcacacacaagagatttcaagtgtgggcccagcaggtgggaactggaaccacggcccaccccaggagccccgtggggaagcatggcctaccccaggcacagagttggcaaatgggcagaactgtgaaaagtatgagactattacaccctcttcccatgagaagacaaaggggtgcaatggcagccaatgaaaagttttaaaatcagaacgctttttgagaaacaaggccccacttctcagcagggagtcccacagaagacagccattttggtttttatctgataagaggaaagctggagaaagaagaaaaatatcaaaatcacctaatcactaatcacccccaacaattaagcaagggttgagtaaaaagtaaagcaaaagtgaaaataaatgaaacaagatcagtgggaccaagatgactgagtaggaagtgcctgagtgagaagtctatgaagcatcaatgactggagctgacatctgctgatagaagcaaacgggtgccaagtgacttatgggcattatctcattcaatccttccacctaccccaggatgtagggactatcatcttcctccacacagatgagaaaacggaggcctaaggtagggcctggagccaggatgcaagcctggggagcctgctctggccctctcctcccctgtgttctagagggagtgcacctttgacccctgcgctgtccctaaaaacactcatggactgtgcccatccttcttgtctaaagctggcaagatgtgacggggatggggacaggagcagggcccataaacaccagagacctactgtcctaaaatgccagacccctgtcctgagctgggaaaccatattaagcaaagggtgtgtctcacaggaaacagatatgagcagattcggtggaggcagcctgggaaaagatatttacaaagctgaatcatggcctcccgccctgctgggtgattcctgcctcctctcctcccattctctcagacaaagaggaaaagcaaaagaaacaccacaacaattctgagccctcaaccagaatcaacccaaagctcactcgctgtgtaaaagaagaagaatactgacagaggttcatgctaaaaaaacaaacaaacaaaaaaccacgtggaagattaacaaaagacatggcatagttactggacaagacaggccagcctccccactcctcaaagcaaaccaaaccaaacaagccccctactgaggacagcaaaggcacacacatggcatcctaaagacaccgtcttttatttaagaaagcctaactaataactgaagaaaagttcccagaagtgcttactatgaaataatttagagatgacataaaatcaatatatgagactcaaagaggcgatggcaaatgaacacgctgaaatgaaaaacaagattgcagagcaactgaaacactgaggaccaaaataacataaatacagaactaataaatgaattagaaatagcatgctagaaggaataaggctaaagtcagaaatcacgccaaaggcaaaacacttgtttaaaggtggtatatgcacacaatgaagttagaagctaagcaaataaacgttaagagaataggcataaaggataaatgactatttaacaaggaaaactgctgtttctaaagcacaaaatccaagagttaggaatagaagacaagtctatggctgaaaagccacatgatgaggatggcaaaacagcaggctggaaagtctggtagtccccatcatgcctaagcagcggagccatgccagcagcggagccatgccagcaatgccttcccagacttcttataaaaagatacccaaggccttgttaagccacagtcagctgagtcttctgttacctgcctcctttccccgacaatccttcagcctactcacactcaattcccttccatacagcctcctcccactgctgcaacagctcagccacattctttgcagtgaagccttctttcctctctcactgcacatggctggcaaactctcctccgtacactgcatcacccttttaaccttttctgagtctacatccggacagagaaacactgctgcagagacccatcaacttcaaccgatagtgctactctgcaagagggtaaggggggcagctaactctcactccccataaaggtggttgccacagcaccattccccttccctgcctcgcccctcagtcagtcacactcttatgcagatcatctctcctgtctctcccactcccactggtccatttttctcactctcacagctgcacgcctacagtacctcaattcccagcctctccatctccttggatcacatcttgtcctgccccctccctcctccctgacacatggggctctggcacaaggaatctattctccaatttaaaacaaatcccattgtgtcctccagggccaaaatccttcagccaccaaactgttagtattctctctgaattagtgaccaataatgctagcattggtgaaagttcccagtgttctacatccttgccaacatttactagtctttaattttagtcattctataggtgttcagtattgtctcatcgtggttttaatttgtatttccctaaagactactgatgtagagcatctttttatgtgcatatttgccatacttacattttctttagtgaagtgtctgcttaaatatcttgaccatgttttaactaagttgctttgttttcttactattgagtttagagaattctctacaaattttggatacaagtcctttatcaaaaatatgatttacacatatcttcttctattctggagctcgtacttccattctcttaacagtgtcctgacaaaagacattcttaacttcagtaagtccagtatttctatttttttctcatgtggatcatgttcttggtgtctcatctaagaaaccttagatttctaacccaaaatgagaaagatatttttccctgaactttgttctaagcacttctgtttttaggttttacattttaagtctgtgatccatttttatcaatttttacatattgtgagaactatggattgaagttcattcttttgcatacggacaaccaatagttgaaaagcctgttctttccttgattaactgcctttgcatgaggctttatttttcaatgttcaactctgtattatgtgttatttttgtctctaaggagtctaccaaaaacatctcaagataaaggacataactttttcctaaaaatgcctacaactattagaaatataaggaagaaaaatatgggcataagttcctaacaatattggattttagacaaagaaagcacaacctaaaaggagtgatacaaaggaagcctgtgggaagcgggagtgcccccaggggtagtgggaatatggtctagattacatatatgagctctggggtgggacacggaaatttaaataactagtacgtaaatcttaagcttataataccagtttttgtcctcactgtttcatatcaaaatgcacttatatatgtacagtaagtcctcacataacattgttggttcctggaaactgggacttcaagcgaaacaacatgtaacaaaaccatttcccctcacaacaacattataaaggaacaaggatgaacaaaaggatgtgatttcaggagccgctgtacatcattttgtttaaagttgcagtttccaagaaccaatgatgatgttaagcgaggacttactgttattattagcaggctagcacaatggcatttttggctcacggtcaacactgtgatactgtgactaggcttctatgtttgcagtggatacctccatgtaaattatgaaaaacagaaatgagtaaagaatacaacatttctgggccaggcacggtggcttacacctgtaatgccagcactctgggaggccaaggtgggcagatcacttgagcccaggagttcgagacaagcctaggaaacatggcacaaccctgtctccacaaaaaatacaaaaattagccaggcctggtgatgcacacttgtagtcccagctacttggggggctaaggtggggggatcacctgagcctgggagattgaggctgcagtgagccatgattgcaccactgcactcttgcctgggcgacagagaacctgtctcaaaaaaaaaaaaaaaaaaaaaaaaaaaaaaagaacacaatatttctgaacactgacctggagttctgtaagagggggtttggggaacactggacccacatggctctgtgacataccaaagaaacaatatctcacacatcatcttataaagccctcttttcctgtaacctcacccttgtggctattctttgagctaattacacaaaagttgtttgttcggtagtttttttttggtaacaccgacataagatcagcaatataagagatactttcaaagcatacttaatactcaaatatcttctgtacctttgctcatgactatgaatacagcaggtaaaagtacacttaaagaccatgttcaaaaaggtattcatcaactactgtttgtgttcattttaaacaaaaaggctttgcaattgtttttaaatcaggggttctggccgggtgcagtggctcacacctataatcccagtacttgcagaagctgaggcaggcagatcacaaggtcaagagatcaagaccatccttgccaacatggtgaaaccccatctctactacaaatacaaaaaaattagctgggcacggtggtgcgtgcctgtagtcccagctattcaggaggctgaggcaggagaattgcttgaacctgggaggtggaggctgcagtgagctgagatagtgcccctgcactccagcctggagacagagtgagactccgtctcaagaaaaaaaaaaaaaatcaggggttccagttgtattctccactaaattcttcttttagaaagaaggaaaaaaaatgaaaaacttaaaaaattgtctccaggcagaaggacagaggagctgtcaagaacctggcctccacctgccagggcgagcctggagtcccggaggtctgagaccgcacctgctgcccagcacatggcagccctcccagtgcacacccacctcacccactcctcacgactcacccatcccagcttgccatggtgtgcaagtttttctcactcctctgaaaaattctcttgataccacactcataccaaagcattctgtaaagggccctaaaggccactgtatcactcagcaaacacagtgtctatttattacattttcttgttcactgcatgtcctgactgaggatcagttacagcaggagaacttgccccttgccttttccacacacggagacaggtgagtctcttatattcccagggagctgccagatgtgtgacctattagcttaagcagtatttttgctagtatgtgattctaaatcactacagagtattttttgccactgctacatatttgcagcaactatgtaatctgcatacccgtattttattgctcaggcaactaaaaccctaagaaaatgttgaggacatactcattatgttttcttctctctggagtacagcacccatcatttaaagctcagtaaacagaaacttctagtttccaatatttaatgaatcactgatgtcctccgtcttttgacggcagagagtcgccctcaagacaagcctctgtcagactgcggatgaccaagtgtgagctccctgtttccttcaacttagagagggatacagatttctgctctagaggacttctaatattacacatcagcacatcccctgggtgttgtaaaggcaagtaagtatttgataaagagaagaaaccactcgtgggtggagtggcagcttccttcagcacatgggtgagctgtgagcccaccacacacggctgcagcagaagagatagggcaccagcctagggtccagaccaggggttaccgacgtaccacaaagatgcattttacctttgggaatcttatttctatcacctcctaggtaaggtagacaggatgggcttgccattatgaacattccgggaggtcgccatgtcctctccttgccagtcccctctaggtgcagcagcagtgctccaacatttggagtgcaatgacatggttgaggtgctgagctcttatcaagacatgaaaatgagctcttctctcctaagctgaaactaatctttctccagtaaagaagtttcacctcctctcacaggtctttctataatgcagaggctgccaaggtgaaatttatgcctttgctgtgtgttttcagagtgtgaatactcataggagatttactcatgatgggtctttactatttacaaagtagctggatttctgagaggagtcactggagaatggtaaatacaagtcaatcactggctgatcatgtattcattataaaagccagaagctgtggtttccattgatataagctcccaaagagcctgtaaaagaaaaagggaaagggagccaaatgtcgagtgaatgccaggatagagtaaactttccatttactcctgctgctcctgagcattctctttcattccctcataacccaacagccctcatctattctagcaactcttcggataaattcttatactgatcaagcaaagaataattcacgctgcccctttaagtgctgtgattatgtaattataatgtggtaaggggttgataaatatttcctgcattccagtaccttcaaaggcctccttactgttaaacggttcaagtctaactgagctccagatgctgttgacaaaatctatcaatcttcggtcaacctttttattttttttaatctctttttacttttcaggattttcttttttttgagacggagtcttgctctgttgcccaggctggagtgcagtggcacgatctcggctcactgcaacctccacctccccggttcaagtgattcttctgcctccgcctcctcagtagctgggactacaggagcccgccaccatgcccagctaattttcgtattttttgtagagacagggtttcaccatcttggccaggatggtctagatctcctgacctcgtgatctgcctgcctcggcctcccaaagtgctgggaatacggacttgagccaccgcagccggccgaatttttttttttaggaaaaaagtagtaggcatttaaaaacaaaacttgtacatatggtcaaggaagagctacacgttagtatgatgccttggaaaaaaagcataaaacagcagcaggtgacacatatctagttcttattatgtgccaggccctgtcctaagaactttatcaacttttaattttcacataaattctctgaggtggtgccatcaccctcattttgcagaacccccaagaggctgtcattggcagtgtgaccacatccatcactacgctacctctctctcatgacaacaaagactgtgtgtggccatcttcactgactcccaaccccacccagctagagtagcataaagggcaggatggcacctggattaccaaagaggcaagatattagaaatagacagcaaaagaatacttgaagtgcaacactactaaggtatcagtggatgtggatataatacatattttgactacattagaataaaagctatcataaaagccttaaggcaaagaaacaaagccagtagcattgaccttttgacatggaggtaccaaaacaatcttttaatttttacatttttactactggaccataatcacatatgatatagctgtatatgtaatgagaatacgcaaactttttgcttctgtagtagttgttaataccagtgatttttttggttgtctttttctatacatccaacatatggtttaaaatttttgaaagtatgctagggtccattactcttcagagaataattcatcatacaatttcttaaacaaagccctttcactatttgaaatgattaagtttaccaagattctacaataatctttcataaatacagaatgaaaagtaagctcgtacctaataaacattgcaacctcggactacatgacaaattacttctttctcaagggaaatttgaaaaaattaatttactagttaccattctaatgtttaatagatgcacagattagggctttctacatggtataatgtaaagtgagcaactaactagaactctggaaatttatcagatactctgatttgagagattcatatttatcagaaaatcatgacttacagcctaaaaactaaacttgtaaataatatttttgttatgatgttaaatttataaacacatcccaccaaactctgtgaaagcagaaaataaattatggggtataataaaacacccaagaagaggtaaacctacagtattatttcatgggcctaaggctgtatgtactgcatgctcatcacagtaaacctcctagcccagaacaaacacctttctatttacattgaaccaaattttttgtcaagtgtaatgaggagctgactttcacgggtttgtggctcttctctgatcccttatcttggtatctagagagctaaggactgcagtcatcaggagccttgcaagctgctcactgaagcagtttctgtacccccttgtggggctccatgtgaattaacactcagcacctcctttcagattagtctatcaaggttatctaaatatatcactatgtggtggataatctttgtatactttaaagtgttaatacaagtaattcttctgcatacaaaattgtattttaatggtatgaaataaagcacaatttaaggagacaagctataaatatgttgtgaaaaaattaacgttaagtcaaataaataagctaagtacagagtgaaaataattacatttccaactaattacatttccaactaattacgatggaaataaaactaatgtcctttctggcatacttaaagattgatccataaacaaattcacagaaagaacgttaataaagtaaatctgaattgtcttcagtgcacaggcctctcccggaaagcagacacaggaagactgcacatctgtgaagaatatctctggatggtgtgcacaaacttactggttgacttgaatttcccagattttataacttggggctaaaataaaggtaatgtaagaggattaaacaaagcactatgggaggaagctgcggaaagtcttccctgagcaggggcactgggaacaagaaggcctctcccaacaacagcaggggcctcaaatggctgagacggggtgcagacaggatgggaagggcaaaactgagcaatgaaaataaagtgttcaatgccaggatgagcttatgctttctttagtaagcaatgtgaaccactggttttgatgtaaagttcatttagcaatcatggatataaatgtatggaggatagaattccagagtttaactgtaagatgctggattagctctgagggcaggtaacagaagactaaattaaaagtgtgatagtagaaacaaaaacgaattctaaacataagagatgggtaatctaaaatagcaagctgtccatatctcttcagttaataaaacatgtcaagaactgcctatattggcaaccattcgtatgacatcaatgcaacaatatgtttacactgaacatcattttcctaatatcacagcacatctcttaactaacaaaaatcctaaatggcagaatgggacaatcaatatatccttaattacctatgtgaccttggaaaaggttctaagactcagtttccatatttttgatatgggagtaacctaccttttagacttgacataaaactaagagacaatggaataattcctaccccaggacctggtatacagcataaactcaaaggaaaactgaatctggaatttatagcctggaattgaaaacatttcaaactgtcataccaaagttggaataaagtgtaaggttagatttataaaagggtttatatatttaaaaagttctcatctcggccagaggtttggaattgtagacttctaataatcttataaagtcactaaacactagtatgtatatattagtatcagagcaaactagttaaatgttggcatgatattaaccctcagatgagtaaatatagtcacagttaaacccagcataagaaaagaagtttcatgttcaaaaactctaagagcgatcatccatacactgactgtatcttttgttaagatttttaaaaattgtaatgctttcatgttatatcgtcccgaaggagtggtttctgttacagtatcatgaaatatagtgacatcaagtatttcatctagttctactgtttacgtgcttttgctgtccaagtgtgtaatgtgagtgatggcagcactacaaaagaatgtagtttttaaaagaaaaagctttgcccagctgcttgtaataaaataaccaaacctcacagcaagggctgattaagataaagataaatatagtaacagatgcataagtctgaaatagatctgagagaaactgttacagaaggatatttccatgactgtcctgataagcaatttttagtgattaaatatgcctgggcatatatatctattttttcatataaaagctatttatactgcctccttacaagttagtagtcataaaataatttttattttcaactatcaagtgctaacttggtacacagcaaagtgatcatttagaaatgacatttattatttataatcaaaagtataatgtgaattaacttggaaactgtcatcttttttctctttttcattttcaaaaagcaagctagttgctcatgaattgaggctctataagttacgcagctctattttaaaaatacataagctctaagttctggcattttatcttccattttataggaattaaatataattaaatttaaataatgtcatgtaaacattttatttcagttatatcttatcttagaaacaacaaagattgatcatttgtaatatatggaagtacttgaaattgcttttggctactccattaaatcagttagtgaggcttatactgtaaaacaaatatgcttctacccagactgtagcaattaagcttatgatttatttagtggcataaaataacacttcatgaaatctgtcctaaaataacatttgttaataaaaccattaacaagattattctgaaatatgacatcttgtaatgagacaggaagtgggactgacctgctacccacaatctggagactgagatccaacctgagggcaaagactatcgagaaccccagattctaaagacagcaacaaacctgagcctgccctcctttggtgctcatgaagagcacctggcatggcaccagcacagctactggcatcaccacccagacacttccttccagctatgcattacggacacggagaagggagaggaggaaagtcactgtagtcttaacaaggagggctgggattttgcctctgcttgctccttccccaccttgggggtaggagggtgtctaagaggtcaaggagactgaggtgcctccaagaacaggagaccagcactgcagtgacagctgtccctgtgctcaagcggcagacttactgcacagcccctccttctactgaaccaatgaaaagaaaagtgagggagtgggtagggaggagaacactggtggcaacctgcatacctactctctggtgtggtgaggataggagagtctctcctcaacatcatggaaggtacctgggctgcagctaccttgccagacccttacacagagagacagcctatgaggcaaagacatgagttacgattattcagcggacaaaaataacataggcttaaaaaacatcaaagcttctctctccttttaaaatatcccaaacttgtaggtattcttgggttatctctcgtgttgttctgccacccgctgggtgttgctcttgtctctgaggttgatgagaatgttctccagttcacattgcagccatctatgtgggcagaaactttgccataaggccatctccaagctatatgggaggctaaaatggttatgtagagctaaaatggttacgttgatctagctggatctgaaccagggtagcagtattattactaaaaggaagaaagatccagccattatttggaaacagctagtagtctctgccacagagactactagagactctgccacagagactactgggcactgccagagacgagtggcagtgcaagatggggatctgtagtcagacctcctacctcagggagcggtggcaccaacagaaaccataggagagccagcaatggacacatgccacccagagaacaggagcagcagcagtgcgaggagcctcttgatccagcctcctcccaccccaacagagagaaggaatcaagatctagaatggggtgaagggggtcctggagaggactgccactcccttgaaagtggaggagaataacaaacagatcacagccccttgccaccaatgggtccctcatcatatatgtatgtgcaggtctatttctggaatttctattttgttccatggctctgttatgtctgttctcacactagtatcctggtgtcttgatttctgtacctttatagtaagtcttgaaatcaggtagtgtttaatctaccaactttgctctttgcatttccatcaaaattttagaaccaccttgccattgtacacaaaaatcgctgtaagtatattatccaggattgcactgcatctacagattagttcaaagagaaaggacatcttcaaaatacttcatcttctgatccacgaacacattatgtctccatttaagtcttctttcatttttgctcagtcatgtttggtagttttgagtctacagatcttgcaaatattgtgttaaatttaaagtatttcatggtttttaatgctattgtaaattttagtgatttttaaaaatttactttgcaatggtcattgctagtacatagaaccacaattcattttatattttgaacttgtatccaatgaccctgcttaattcacttattagttccaaaagtgttttggtagactctttaaaattttatctgaacatatcatgacatgtgtgaagacagtgtttaaattcttctttccattctgtatttttcttttttctttttgagatggagtttcactcttatactcttgtagcccaggatggagtgcaatcgtgtgatctcggctcactgcaaacctccacctcctgggttaagggattctcctgccccaacctcccaagtagctgggactacaggcatgcaccaccacacctggctaatttttgtattttgttagagatggggtttcaccatgttggtcaggctggtctcaaactcctgacttcaggtgatccacccgccatggcctcccaaagtgctgagattacaggtgtgggccaccgtgcccagcctctgtatgtcttttatttcttttgctcacttattgcactggcaaaaacctatgggacaatgttggataagagtgacgagagtggacaggcttgtttacttccccttttagcagaaaagcatatagtttttcatcactaaatatgctaactgtaaatgttttgtaaaggccttctgtcagtttgaggaagtatccttttgtttctattttatgaaatttttaagaaatcatgagtcaatattaaattctgtccaatgctttttctgtgaacattgagatgaccacacaattcttgtttctgttaaaattgtgaattgtattgatttataaatgagataaatcctgcttggttatgatgtattatctttttatgaattattggatttgatatgctaaaattttgttaggacttttacacctgttttcatgagggatgcttgtctgtatatatctttcattaactatttttgtatttggtaggaaggtaatgctggcctggcctcaaaccatgagtctggaagtatgctctctattttctgaaacagttggagtagaaatgataatatttcttccttaaatggctgactgaactcactagtgaagctatctgctcagagctttctttgtggaaaaattcttaattacaaattcaatttcttaaaaaagtacagaagtattcagattccctattctcatgtcatgttttggtaattgtgtcttgcaagttggtgaatttgctcctataatgtttctcataatattctctttctactgtttaaatgtcgtaggatttgtagtggtgaatgatctttcaatcctgattttggtcatttgtgtcctgtctccctctgacctcacctctgacctaccacctttcatttccttgatcaggttggctttttttttttaaacattttcaaagaatcagctttggttttactgattgttctctatttgtgcataacctatttcactagtttcctcttttaaggtaaaagtttagatcactgattctagaccttttttcctaagattttaaagttataatttccttcaagcattgttttatctacatcccacaaaatttaatgttttcattttcactaaattcaaaaatacattcaaattgctcttgtgatttcttacttgacccacagactacttagaagtatattcttttattttccaattatctggagattttaaatatgtctttcggttttttatttctaatttaattccactggtgtcagagaatatattcttatgtcagttttttaaatttgaggtttcatggtccatcattttattctgataaatattccacgtgcattttgaacgtgaattctgttcttctgttgagttctccgaaaatgttaggtcaaattgtttcctaatacacctaaagttttctatattctcactgattttctttttacttgctctatcaattatgtaatctccaaccaaaacagttgatttatttatttttccttttatttctggaaattttcattctatgtatattgaagttctattgttatgaaacatcccttctttatcttaggtaatatttcttgtcttgaagcctagtttgtctggtgttaacatagctgctccagctttcttttctattgttagcatggcatatctccttctatccttttagttttaaacctatactgtatgtttatggttaaagtgtgtcttttataaacagcatgccattgaatctactggtttaatctgacaatctcttccttctaactgtattgtatacaaaatttacatttaatgtaactatccacatgagtttaaacttaccatcttgttgttttccatttttatcacctgttgttacttgctcttctttcttttcctgtcttctttggaatgagtgtttttagtattccattctatcctcactactggcttactagctgtatttctctccatttttagtggttgatcaacagtggcctttctcagctagggctttatgagagaatacagctaacaggaaataatatgaatactttaaaatatcccaatgatggtacatatacctcttagatgcacaggacagaagttaattcattatgtacaatagaagtcttgcagaagtaaaaattaattttcactcaatttggggaagttttggccattactttttaaaatattctttctttccccacttctactgttatatccactggaccacttgataatatgtatatacaatagacccaggtcactgaggctctgttcgttatagtttttaggtcttttttctttgtgtactctggtttccacggtgtctatttctgtgtcttcagattcactaaacttttcttctacagtacctaatctgctgttacttccaaaatttacaatttctgaagtaaataaatgcagcaaaattttcacttcagagattgtacattttacccctagacatctcaaatagttgttttatatcttccatttctcttattagtttttttcttttaaatccttgagtataaacgtagtcgtggctttgagatccttttctgccaattccatcatctctgtttctactgactgcttctgctcctgggtcgtattttcctgcttcatcatctctactacttttttattggttgctagatattatgtaattttgttctgtgctggattatgctgtatttcttcaaagcatattgaatgatgtaccaaaggcagttaaattctttgccaagcaggtggatccttttgggacttgtttctaagctttgttaagacaggcctagagaattctttattttaaggatagtatggccctaccaaagcataatccttctgggtttctactttcttcagggtgtcctacaaagcctctttaatctgctattcagaattttaaatgttcccagttcacttctgtgtgaactctgggaattagtctgcttacagttctctttctctggtagttcctttgtggctttgttgagttttatcaaatgaaagcacatcttggcaatcaccaaccaactcaaggtcaccctcgtgcaaatttctgttcttctgtgtagctacttcctatcctgtgttgtatctcacatattaatccacttcagcctcctcagaattcctaggttcctctttctttcactgtagtctggaaaatgcctctaggcagaaagcagcagtgattttaggacttcccttagtagattattttctctcaggatcacagaactgtgctacctgtaatccagtgtatgaaaacagctgttccatatatttgcccaattctctagtaatttaaagtagaaagacacatttggtctctgttactctgttactttctatttctctggaaatagaaaaagggtacttttgaattagacttgagaatgaagttttgaactgagccaaattaagcaggcacctttctcttgaataaccaaaaatgactagaaagttactgagtcagtcaacaacacataaaccaatgggaaaaaaagatttttaaaagttcagttgaaggcaataactagagaaaaataaaagcatttcatgtttatactccacttagttcatactgttcaacaaactgctttgttctttaaatattatttttgcaaaatgtcatcaagataaattcgagttaactaacatcattaaagagtagtttatacatccattactcgccaaccttaaatttacatcagttatgtttctgtaaaacccagtgtacctgagataattttgaattaaatctgctttctaatagaaatattttaatgtagtattgcattcctaatcatgaagaggttatctgaggatgacaggatcatctgcaagaggtaccaaagacctagaccagctattacggtcttccctcgcccctccaacacagctaatcagacagcattatttccactgaacatgaacatggccccaaacactgtgaccaggctgagccagcatatgagagtaaacttagccacttgtaccctatttcaataacagctattataaaacttaaaaagcagttgctatgagccaggcaccattctcaagcactttatacactccatttaatcctcacaaaactctatggcactgacacatccattacggtaacactaaagattagaaaacgaagtcccacaattggagtggggtgggggcgtggggtggggacaacattcatgcctaggtgatctagttcaaaactccgtaactactccatcaagggctggcaaactatggtcagtgaaccagctgcctgttttgtgaataagttgtttctgccaggatgaaaaaatcacagaactttcagatatagtcatatagtagaaatttgcttggggagggataaataggaattatcgatctcacttacaggccacaaaagttgcaagtggccatggcaacaggtatgtttcttgagtgttgcaggcacttttgttctgctgcagttactgcagtgttgctgtgttttaagatggtactccacatgttctccccaggtcactctactatgggttatctttagagtagaagcagaacagtgccaagaacgcaaactaggtctttgcttttgagtcaactgcaaatgaccaaatgtctatttgatgcttggaatacactgttggaaaggattctgaagccccatcctcacttctataccatggtttaccacaggatatgatttgtgtcatcaatgacttagtctaccagattcagggctgaatttcacacttattaaaagtgagctgtattcacttgtttctatatctatacaactaatagtaaaaaagcacaaatgttttcaggaaaaagtgttaggtttaataatgggaaaaataattgttcatgtgactttttgttgtcgttatccaaaataactcagttttaaaagccaagtgtgaagaaaaagttttcatattattttatttaaggctagtatcaaagagttcagacaattatttaaactaactctttaacaaaacttcattataggtctagattagtgaaacgccaaattaggaaatattttaagtgttttgttttctcaaaatatgtaaatgtagaataaatccaataacactagagaatttctgtttccacattccctccctataccatgacccattcctcagaataaattttctgactattcttgtatttcattcttctggtagtcatctctatatccctaaatagtaaacttgtatctaggtttctggatttaataattttacataatgtctactgattctcctaaatttaaaaattagaatttagctcatctacactaatcttcaactgcctctcccaatttttagctcttctactagttgtgattgtaagtatacagaatatgattacattctctgtttcaccaagtccaccatgtatatcaatttctcactgatactggagccacaacacacttttcctctgagcttccacaacccaccttaggtaagcttcacttttcctataacatcaagattataaccactatcaagactttatcacagactagctgtgttgaaaatcagtaatcagtatctgcaatattatatatacacacacatatatgtgttatatgtgtgtgtgtatatacacaatttaataccaggccaagaggtatactaaaattacatttcattctttacaaatctaatgtcataatctgaccactacaataaattttaaaaatctagttttaagattaaatggacccacttttcttgctgattgcttaaaagcctgaccttcccctacaaactgaggcatgagtggaggttctcctaggatttctaattgctttttttctgggagcataaggttgaagtggagatagatgttatccccaagttgtcaaccattgttttgcttcaagagtcttttgtactcctgttccaatttggaatggctgttttctggactattgtatagccattattacctcaaagacctgctttgactgtgcaattaggttggttcctctaattcctgaaggccaagtctctctttcttggttattactttgttttcctggagtacatactcaactatctttctgataaatgtatttgggaggctgggcatggtggctcacaactataatcccagcactttgggagcccacggcaggaagactgcttgagcccaggagtttgagactgagaacagcttggacaaaatagtgggatcctatctctaaaaagcaaaaagaggtatttgggaagctaacttttctaggccttgcacatctgaaaatgtcttaactttgctatcttatatctagacatatctttgctatctcatatatatctatatacacctcaggtacagaattctaggtttaaaagtgtatttacctttgggttttgtaggcaatgcttatagcatccatgttgctgatgaaacaactgatgccagcttaatacttcttcacacacaggcaacttgtttttcttcctctctgaaatcttttatgatcttctcttaatcctccgagcactgaaatttcacaaatacacacccacagtgactctttttcattaactgttctggctttcagtgggtctttttaatataaagatgtgtgtcttttccatctctgggaattatcttcctccactattttgataatttcctctcctctctttccttttctctagcttcattaagtcaaatgtcaaacctcagaggttaattccccacatatttgctcttgcatttttttttttttttggtctttgctctacattttagaaggttacttcaacttcattttctcacatttctacttaaattttcatttcagcaatcctttaaaaaaaacctaatagctcttttttgtaatatcattgtttctgtattagctgtttccttaaggctcagttgtttttctttcacactgtcaattctcctcatgtactccatgacctcttggttatgtgttctttaagatagtaacaccaggagagtgggaactgttctcctccactcgtgtcagttggcatattttgggggagggcctcctcccttaagggggaattctgaactctatttgccccaataggcaggctttacttgatatgaacagaaaacagtctgactatcgagcagtagactccacagaatgagaaggattttattgtgcaacatcaaaatccatatcatcaggagtcttagttttctgaatttcgtctcatgtctaaagaagtcagtttttctgaaaacttgcatatcttcagaaacctctttgcagtacatttaggctagggcttttcaacccgtctcatctgtaaaatcaatcccctcttcctaaagagttatatatctcatttgttgatgcctcctttcccgttttctttggtattcatgtttgtaattatacctttttttttctcttttatagtttatgttttcattttggtgaagccttaaaatgagaaggcagatgacaatgctcagtaactagtctgctttcttgacccagagccttaatgatttttaagcttataaaggaaagttacggccgggcacggtggctcatgcgtgtaatcccagcactttgggaggctgaggcgggtgaatcacaaggtcagaagtttgagaccagcctggccaacatggtgaaaagccgcctctactaaaaatacaaaaaattagctgggcgtggtggcagacgcctgtaatcccagctacttgggaggctgaggcaggagaatcgcttgaacctgggaggcagaggttgcagtgagccaagatcacgccactgcactccagcctgggtaacagtgtgagactccatctcaaaataaataaataaataaataaataaataaaaataaaaaataaaggaaagttacaatcacacacaaaagtagggtaaagaccacaatgaaaggtcatgtacttgatggccaaccttcaaaaatatctgtaagccaataacattggttaatttgtggcctctacaataataaaccctgagcaaagccctctataactggctcatatgggtaaggattacacaatatctagaaaccagttgataaaaatgagtgtcatataatttgattttgtaaccaggtcaagagttctttgcaatatctgctacacaggttcacagaataatggtccagaaaggtacaccaggcctcacagagtccagtactcttctttaacaagtaataaaaattcaagagttgggtgtgtatgcccctatgactggggcacataaaggaacaggctcaggcaatcttaatcacaggtaacttagaggtatgtatagttgaacataaacatatattttaagggttagatagcaaactttataaaaaattattaaactgacattttagacaaagtatgcccatgtgacagactgctagtgcactccgtgtgtgtatgttatattttggtgagaagtctgagaagcacaaagctactcaggagcaaaaccagatctccagtactataatccaggtctcttgattatcagtccagatggcagaaagggaagtgtcagcttagcctacagatgcatcattgaaacttagaactagcaatgcatgccctagaaaggtgccccagctactaatgtaaaaagccatgggataactaacatgtgtatggcactttccagtttacaaagcagtctttaaaaggtaacaaatataatgtctttaaaaaaaaactttgcaatacagatactatcatcaccttcattttacagagaaagaaaagatcagagacccaagtaccttgccataattagcagcctgtcacacaattagttaatggtttaaaccctgtctccttaactctaaacctttacaatgtaggatgaggcccatgtttttcattttcaccattcacctgctcccttcttacggtgtcttgctcttgtttaatggctctaacagccgagtaggttaactcaaggttttccaatgtatgtcttcagttgcctgcacttttattcctttgggccgcatctgcttgcccctcagagtcttccgcaagtggaaagcaagtatgaagctaccacagggagtacacagcattctcccttggtagtggttgcaactgaagaggtaaaagcattccactgaaatgctgcatccttgctgttagtggtttaagggagcctcggtctatgattcagaaacatttggttgcttcttctctcaggtactgagtactccaggcaggcagggcagaaaggtgatgtagggagctcatttcccctttcctagccccttttctctactctgtaaatgcattccttcacctaacactactaccaccttttccatatgagttgttggaagatgacaacgcggatttgctggttccagcccctccacccacagatattgcacttttgcccagagcccctaattctggactcacagatctatcctcctaacttccagtttcagctacgggctgctctggtcttcatacattaactccagatgaccaggaggatgttctcaagcagaaaaaatgaagaccagactaaaaccccacagagtcaacctccactcaaggaccaacaatcgtaataaacatcatcattccaaattcagtagctttttaccattaaaactttattcacgcagaaacagttttcttttatacatgaaagcacaaagtgctccacctaaactttgggttaaattaggcttcagcagtattccataggtcttctcatcctatgtaacatttctataatgagaacatactctggtttaaaataaactcattccaacataactcatatctatgttgggagggcacaaaatttaaagtgtttgcagccatatgaaagtgcaaggaccacacacacactgagaaaaacataacacttcctagacatttttttttttttaagagacggagtctcactctgctgcccaggctgaagtgcagtggcgccatctcggctcactgcaacctcggccttccaggttcaagcgattctcctgcctcagcctcctgagtagctgggactacaggcgcacgctgccacatccagctaatttttgtattttagtacagatggggtttcaccgtgttgcccaggctggtctcaaactcctgagctcaggcaatctacctccctcagcctccgaaagtgctaagattacaggcgtgagccaccacgcccggcccatagacctattttttaaaacccataatacttctagtttttatgacaatatgccagttgtaactatttcccagtcttctttgaggtaaatccatacatattcaattgtgatgcttctaaatatattcaaggatatgcataatacaatatctaagcatgtatttaatagacaagaatataaaacaagatgctggcatgactactattatatcaaggtttatcctactgaggtggtatgattcagataattaacactttctttttttttttgagatggagtctcgctctgtcacccaggctggagcacagtggtgcgatcttggctaactgcaaccttcacctcctgggttcaaacgattcttctgcctcagcctcctgaggagctcggactacaggcgtgcgccaccatgcccagctaatttttgtatttttagtagagatggggtttcaccatattggccaggctggtctcgaactcctgacctcgtgatccgcctgcctcagcctcccaaagtgctggcattataggcgtgagccaccacgccaagccagataattaatattttctaagcatctaagaaaccagtcttcatgaactccctcataaaacatagattaattcacagaaacacttacgtgtctggaaggcctacagtgaaaatatgatagagacagacagtagtctaatacaaaaactatgtagtgacagatctaaatataaacgtttaaattttccatttcattagttcatacttagattgaaagataaacatttaaattattttcaatatatgattctgctagtaatattctaatttcaatagaaaccaagtgcctttaatgagaaaagtacattttattctgtattaatgaatttccaaatgtaatgtttcaagtttagtcatgttatacttctaaccgtgtcactttaaaattacgagaaggaaaagagggatatattttgttcattttaataaaactacatgatacaaaatgcagttgaagaaatgtttgagttcagctacccctttatgacacacagcatccagtcaccaatgatggctttaaacactcgtgctctgggaaacgttcctaaaattttaaatactattccacaaaacaaaaaaacattgccaaatccctttatgacatgatacccagatctgtacaaaccttatcttcaaaacctaactacaaagagaaacaaagtgtttacctggctgggtctacagagctagtgtaagaactgtctcccagcaatggagtttaaactggcatcaaactctatcaagtgagccagaagaacacttttactaaaattaaaattccattttagattttaaaaggatatgcttcttaagccaattaaagttcctgtgaaggttgtaagcaactaaaattgactctggttagcataaggaaaggggatttttggaagactctcagagaccatcaaagggaggctccaaaagataacatacagagaccagagagaccaactggcaacatgcagggaaagggtcagcacatctccatggagacttccagggctgctgggctccacctcccactgtaaagccctgtggaagagccccaggctgcagaaactcaaagttccacacccaaagagaaaggaggtggagggggccctggttcgcttccctagtgggaacagccctgtgctttcctcatagaaactggggtgttctcaggaaggagaatagatcctggacagctaaaaagcaacaaacgtctactgtagattctcaataagccaatgataccaatatacttctcagtataagtcttcagatgaatttaggttatattcacactgttttggcttctgtaagactcaaagtagacaccccttgtagagcaaaaagggaataaacaccttctgcttgtgctgcacctagaatctttgttcaattctgactgtgatcaaaatgaataaagaatcagtatttgacctacccggtgccatatgtggtacctatcaaaccaaacaaggtagcaatgcacccaccaaaatacacttgtacacaatccaaataagtttgcacacctgtatttatcactttgatataaagaataagtttgtttcaatgcttttaaaaatatattttatgaatagtatgcatagaaaaatttcagttggaggttgctactgcccaattaaaaaggatgaaaaaataactgtcctaatatgatcaaactaccttataaaaatactaatgcatgaattgaatttcatgtagaatgagtcaaatattaatagtccaaatagggaagatatataaatttttattagaaacatgtttcaaaacacttctttaaaataataatttttaagtttcccttctccaaatggtcagtgttacaaatttggaaatatccctcatatagatgtactcaggagttagctaaaaggacatttgtttgtttgctagaaacgaagcaaaagataaatctgaacttagagcagcattcatcaaaacacaatcaaaaaatgctttacaacaaattcaatagaaaagagcatgcttccaaatggtaatggtggtatgtgcatttgcttgcagagacaattaatacatgcagctggtgtcaaccttccgtaaatttcaatcaaagcttgacagctaccagttatatttcacacagagtaattatagcaaatggcattcaggcttaatgttctgccatttcttttttttctgaaatgtaatcaacaagatattaagactgcttctgcttagttttctttaatattcacagtgacaaaaataaatattcagtctaaggcatttagtaaaaaatgtaagtgaggaaagaagactacgtttagtagggcttgtcctatgacaattacttcaaatatatgtagcctttctgcataataagatattatattagtccttctataatgcaatacaaaatcttcaatatgctttgttgttgttgtttttgagaagtttcgcttttgttgcccaggctggagtgcaatggcgcaatctcagctcactgcagcctccgcctcccaggttcaagcgattctcctgcctcagcctcctgagcagctggtattacaggcgcccgccaccacgcccggctaattctttgtatttttagtatagacggagtttcaacatgttggccagactggtctggaactcttgacctcaggtgatccacccgcctcggcctcccaaagtgctgggattacaggcatgagctaccgtacccggcctaaatatgcttctaattttctataattccaagacttttctatatatattgcacaagcatgtgagtatcaggcatcaaatgcttttgtatgttaaataaggaaacacaacagcagctccccctggaaattgtgttattctaaaagctggtgctcctacacattctttatgtggtgtcacaactaaaatagacattaggataacgaacatatggtccagatttaataggccatgtgcttcaatttttatagtaaagtatttaaaatgtcaattcttgtatccaaatgtacttttaaacttcatcccacaataattgcctatttaatcccactacacctgtgcctgctgaagtacacttaaggtgctctcatgctcccccagcttgctactcttttaaaatgttgctttctacacatcccgtcagtgtcctgggccaatcagcacatcttaggagtcaagggaaatcctgaagccgagagcactgtgcgtttgccttgctcctccctgggcctccattcggcccagcagaaatgggagcagtgcccagcaccctcccacctctgtcttaagaccatcaggattcatctgaaaacacccgatacccattctaataaccttctcattcacattctttctcccatcttctgcttaatttttccatcaccacatttactatggtctaacatagtatatattttatgtatccgtctgcctcctcgaatgtaagctctatgaaggctgggggtttgtctctgtttactactgtatttccagccattactaacaagtatctggtgcataagcagtactcaataaaataattatagctgaatatatttcacaaacttacaaaccaaaaaaaacttcactgtaaaatcaagtaagacctagtaggcatagaacatactctaaagaaataggagagcaaaatactgactacataacatttgtactttagcatcaatatacatcactgactgggatttaggagaacagaacaatacacagctgtatcagtcaagtttcttggcagctagcaatggataccaactttagctgaagaagaatttgctgaaaggtttttgggtggcccccgaaactaccaggaatgctgaagaattatgttcaaaaagggcaaaaaccagtaagacaccatgaagcaggactgaagccccaagccacacccgagaggcccacttctgataaggaccctgctgccctgggcagagacaaagctgctgaaactcagcagggacccagagatttggaaagggggattaagatgccggcaaggttaaaaacacacacatgcacacaaaaaggttcactatagtcatggtgtacaacacccttcacttgagtacttagtataaacatcaaagagaaaactcttccaggtattccttgtaacacagttatctcctaatagctgctataggagctattggtgatgacaggattccactataactgactagtatgaaagtgttaaggttcagtggctattaattagcactgtaagtgaaaatagttgaaaaactatgataaatttcacatatttgaacagcaatttagatttctgcaatatcaactggcattgaaaatgttacatttatttaaggtcgctcaaaataaaggtaccaaattgaagtatttaaaaccctctgtctttataacagatgtttttaaggcatcaaaaataacatgcatatgtgtacattcatgaggcaaatcagtaaaaaataattacacagtggcccccaaaccaggcattggcagggggatacctccagttccagagcaatcactgacaaacaaattcagtggtttgcatcttaaaaggatctgagctctttgacgaacaatttttgccactttaattctgcacagccataaaacacaaataattccagaatcttaatatactttcttttctctcttctcagaggtggaaaagggctgaccaggtatatttgaatttaagaaagacaatctgttcttttgagtctaaggattaaaaataacgggcacacaagagaaggtctctctcaaggtgttatgtagggcagggaaacaggtactgaaactgtgcctattgaaaagcaaactacagcaacaaaagaaatggaaacagaatacaaacgtgcaaagcatactgattattagcagaaacaaatccaaaaaaaatatataagcctattttctgggtatgcctcctaaaaatcctagaaaatacaaaatatagagaaaatcattttatttcatttaacaaatatttactaagcacctatcatgtaatgagcaatgggctagatactgttaatacagtagtcaatcaaatgaaacagttccttccctactggcactcagagtgttatgatgacacatcaatgacctcatcagcactagcaaagaggtgaaactgcaaactggaagatgacaggatgttataaggttcttatttcaatacctaaggatgtgttcttaatatacttgaattaaaaactcaaatcctttaggattttacaatacagtacttattttctgttgaattactagtagtagttgtaagccttatgaataattagcaaaaaatgtataactgcaaagtcaagtgtataaaaattgagaaagtaaatatcagattggcaactcaatttatatttctaaataacagaggacttaatccacattaaataaatctttatgtaggttaacaacaacaagatgaaagtgaacttcagataaggaagataaacatctactaaacagtcaaatatataaaattaaagcatagaaaaggccccagatccataaacctggctaaccaagcttcacctaaggttcctgttcaattttgctaaagaaggctatatgaccaatcctaggagaattaaacttccttagtagttcaaaatgatgctatatctgaaacttgctctctaagggaaattaaactgaactagttgctcctaaccacacagaagagagtaacaattaggcaaggaaggggctgggatagcaaaagagaaaaaaggacatccattaacactaaaacacattaagttacagtaacaatgatgactagtacaacacacactgggtggtgatctaccagaaccctttcaaagccttctacatgtattcattcctgtcatcctcccaatgccactataaaatatgcatgaccactcttgcacttaaggattaggacagaaacacagagaggcaagtcactttcccaaaaggccacagagcaaagtttcagatccaggcagccctgctccagggctccaaatcaccacggagcaacaggtgaggttagtggttttgtaacagcccatattttctcaatctctttttgaaacactgatgtgatacatgactgatttcaaagtagctcattttaaatattaggcattcttggacctgtgaaaaattaatcttagaggagctctatggtgatttctcatttttcaaacacttgcttctggctgggaatagaacgggaacttccctaggcatgtttaaagttggccataaaaaaaggtaatgcaaaagtacagttagataattaaataagtgttctcaaccacttgacagagtgaatcttaacacggcatcaggtaaaagtttgctcctttgttttcataaaatgtcaaccacttcaacaggccaaatctccaagccgaacagaaatcccataacttatcacccaaaaggatgactatggccatttccagaggctttctctgccactgaaatgctagtgatcaagtgtaattattaacaggtcaaggaataaattgattccagggcagtggaaattatgttgatgaaatgaaaagtggtcttgctgacaatgcattatcatttctagacagcacatctgaacatcaaatctcacatcatggagatgtgccaaatgccagtgacctagtttcattagggtgggaaagatagagcaatctatcctttgagactagtaccaaaatagctttctaaaatacagcttcatgcattaaaggttttaagtgattgtccatggaaggacaaaagtaataaccagagccaatatcaaatacaaatttcctttacgtaccccataagctaatggggtacataatattatctgcatttcaaaatttgaaaaaaaaattaggaacaggtcgagcgcggtggctcatgcctataatctcagcattttggaaggccaaggcaggcggatcacttgagaccaggagtttgaaaccagcctggccaacatggtgaaaccctatctctactaaaattgcaaaaacattagccgggtgtggtggcggacgcctgtaatcccagctacttgagaaagcgaagcacaagaatccactgaaccccagaggcagaggttgcagtgagctgagactgcagatgacagagtaagaccctgtctcccaaaaaaaaaaaaaaaagagtattgcatatacaaaattgttattaatgtgaattctcaaaaatatggcctatgtctatctacagagtaatgtgactttaataaaattattttggactctttttccaaacaataacaaacgagaacaaaacactgtaacaggtcattattttttcgaaactcaacaaaggttactgactcactttgcagcgccacatctaaagaaaaatgcaagtaatgaaacactaaactttttttaaaaaaggatctttatgtgatatgcacagaaaaacataaacactgaacttacaacatagcaccatggaaacaaaacctgtcaccttatacactggcaagactcaagaacaatagcttatagaacatagaggacaagaaacaagtctggaagacaatgggtttataaaatatgtttgccatgtggttttcttccccaagtaaagaatgtgaaaatgggataaaatcacctcttaaaagaaatgtattatacaacacctgtaatgccagcactttgggaagctgaggtgggaaaatcgtttgagcccaggagctcaagaccagcctgggcaatatagcaagacactcatctccacaaaaatttttttaaaaaaccagccaggtgtggtagggcatacctgtaatcccagctacttggaatgccgagatgggaagatcagttgagcccaggagttccaggttacagggtaagaccctatctctaaaaattaatactaagatttccacataccttttaaaatgttaagggctaataatctcatctataaaaatggatgcataaaataccattccaatttaagcatatacagaatccagaattacaatttagcatgaaagaataatataccactaccatgtacagttcattccagaaaagctagactctgtcaacaatggaaaatctatctaaataattccagtatcaaaaaatgtagtattatcaacatttcaagagagttccttaacatgattaaggaagtatatctcaaactaaaagccaggagaaggttttatggtaaaacagaagttttttgtaagagttgtaagtgaaaaggaaaggtatctaaaacctaacattaaatcaaaatagcaagctgcagaagagaatgtataatataataattttagggaaaaaatctatgtatgtatgtatgtatgaatatatcagtgtatgcatttaaaaatttctaaatggcaggcatcaaatcattaacaataattacttattggggctgttttccctattgtttgaatcaaaatcaagtgacatgagacaactacttttaagaaatcctcaattactaaaagatgaaattttgaaattcctcaaaattatttccaactatgattctgatttcctaatcagacattattagtgtttatatattttcctttttttaaaaaaggtagcaatattacttttgtctttgaatgctctgggagttaaatttggaagtaatgctattcctttcttattaactgagattaaaacagtttggtatgcaagattccccaccaaggggacacaggctctgagggtagggtgctcaaggtttccccactggaggaggcatcgtagaggcagcaggtgagttttaatgatgaggtgtcaggaaagaaacagcagaaggtagaagaccaaggggaagaaattgtaggaaaagaaaacaacggagggctggcaacatgctgcatgaagtaagatcacacaatagcactgccacacaagggtgccatgcctagcgaccacaggatccagcaatatagtcacaaagtcctactttaaaatgaaaaaataacggggaaagcaagacacacaaatataaaaacattctagtttcacagtgtaatcttacgcgtagcaaaaagattattttataaaagtcaattttacatacgtagtaaagaaaagaaacctgaacactgaggattttttttccatctcttccacaatcttgacagatggtgctcactctgagtgacaagtaactataaaaaccagtaagtctatttcaaaggaaaagtggtcctttaaactactcataccaaatgccttttaagatcgtcactgttaagtctgatttcacctttgtgggtaacaaatcttggaagtagtttggcgcgatttcaacgaatggaaaaatagaaagtctggatatacagtaagataacttttctgattaagtggttggtcatttcacaaaaataatgcaactgaagaatagtgcatttattaatttaatgaatcatagcccttcctcttccagccaagatagggtagcaaagactggatttaccttcctacctgaaaaactcaaaaaacagttttcaagacactggataaggcaacaaaggacagtaactgttgaaacaagcgacatgagcccttagactgcccaacctaacttggatgaatatcaaaataattatgctcaggaaaagaacccaggcaaagaaaagattccgtaagggataataacatttatgtcaaattctggaaacaaaagctaatcttcagtgacagaaagcagttcagtggtggcatgaaaaaacttttaagagttttttctcttcttcattatcttggttatgatttcatgggtgtatatatgccaaaacttatcaaattatatgctaaaatatgtgtagtttattgtacatcaattataacttaataaagctgttaaagatattaaaaatgaagaaaaattatcgcaaacaaccattaagtaacaacaaaaataaagtgttagtccttacaacgtgccaggtaatgacataggcactttacatgtattatcctagtcaattctcacaacaacctatgatataggcattattattatctttattgtacaaaagaaactgagataaataatacagagaaataacttgtctaaagaaatacagttcagtgatagagatgggatttccaacagtattaggctatttgtgttgctataaagagatacctgagagtaatttataaagaaaagaggtttaattgcctcccagttctgcaggctgtacaggaagtgctgtatcagcatctgcttctggtgagggcctcaagaagcttacaatcatggcagaaggcaaagggggagcagacatctcatatggtgagagcaggagcaagagagcaaggagggggaagtgccacacagttttaaacaaccagatcacctgtgaactcgctcatcaccaaggggacggtgcaaagctgttcatgggaaatctgccccaacgatccagtcacttcccaccaggcccctcctccaacactgcgggtcacaattaacatgacatttggtggaaacaaatatctaaactctatcacaagccaagagggacctcactccaaagcacatgccatgagctacttattcgactccacaggtagacatggctagtcatcagatgtttaaccataaatgttactgctgagctagtgtgttcagttttcttaaaggaatgtaagcttaactctattattccaaatcagagttcttgttatcattagacttgacatttacgtctgtcggatggcatgctgacaggtacacactgaaatatctctctgatggtaagtccaaacaattcacaccctgtttttcacattacaggcactagaggttcaaaaaagcagtcaccaaactggaaggtttgtaaaaagtgaattcagttttatttttaaaagataagggaaatgaactgccgctcttcttaatttataggcagaactaatttaacttccttgattaactttctacatattctatttaatgactctgagaaaaaggtaggtctttcaacatctgctttctagactgcttaaagtgattcttgagaccatttatttaacttgatacaaaaataaacactatagaatattaaaatgtaaataagaccaccttgattactgctggataataagaaagtaacctgccactcataaaatgaataacctgttttttctaagagagcaagttactagcaatttttaaaaatgagagcaataaacactgacataaatttgaggttataaggaggaaattaaaatactcataaccaaaatcaccaattaattagattccattacttacataatttgaacacataaataaagctaattttaatgaaaaaagggcagttaaagtaaataacatactcatattattaattctccaatcttttctgtataactatcctttgaagttaatctcattctcttttctccaggagcagtaatttacgcattcaaatatacacactgaggacttaccagtgggctaggccccttggtcttacactcgagagaacaagagatgagcttcaaaaacttagttttacatttatgatctattttgagctaattttggcacaaattatgaggtttacatcaaggttcttttttattattttctgcacatggaagtccaatttttcctacaacacactttctccattgaattgcctgtgcattttcctctttcaggatttttttaaaagtcttgaattttagggagtttatttatgatgtgtctgatcgcggatttctctgggcttgtttaggtttactcagcttcttaaatccttatatctttcaccaaattaggaaagttttcaaccattatttctttgattttttcccccctgaaatacactttctcctctccttctggaacacttgagacacaaatgtttaacctttcagtattatcccacaggttcctacggttcagttcatttattttacacaatgattttttctctgttgttcagactgaataataatttctattgctctatcttcagattcactcactctctcttttgttcatcttcattctgcaattcagtccatccagtttgttttttattttggcaattttattttttaatcctaagatttttatttgttggagttactctcctggagttctctctgtctgtaccaatgtccatttctgtgtttcaggatgcctttagaacaggcctctggaaggcaggaaaaaaatgaatcccacggttttttattttccacccaggctgctctcgaaaactccacatctgtgtaacagtctacttaaaagtgtacttgatatttaatgaccattttgaagccaacacgtccaaaacaatattcttgattgtcacttcccaacttgctttttgaatagctttccacatctcagtacaaggcaacctctcttttcagttactgcagccagaatccttggagtcattctttacatcggtttcttttatgttacccatctagtctatcaagagattcttttggctccatcttcaaaagataccgagaatctaaaccataccccactactttcaccattcccatcccagtagaggcccctatcacattccacttcaactacagcaacaggctcgtggcaggaataggcttcttccttctaacctggccctactattgtctgctcctaacacagtgatgacaatgaaccttcaaatatctaagagcatgtcacagcacgtcacacctctgctgaaaaacctacggtgagcccccttctcactcagggtaaaagttaaaagtcctgacagtggctataagacctctagatctgactcccctattgcttctctgacagtatctcctattgctctcctcctcctcctctctgctctggttgtggtgatgtggtgaatgttccaagcacactcccatctaaggcctctttactagttgatacttttgactgacatgcttttcctcagatctgtatgattaatttcctcaactcccttaagtctttatttcaatgttaccttttaaatggggtttgctctgacctcttggttttaaactacaaacccacactctccttggaccccttcccctattttttttttctatagcaccttccacttctgccataatacacaatttatcatgtgctaggtctactgttcctgtgctagaaggtaactgcttggtggcaggatcttcctctgcttgttcacggctgtatccccagtgtccacatcagcacatgactcaacaaatgtctgctaaggcaagtgagtaaacatgcctggaaaacagtatgtgagcaggaggagcagtggtaggagctgaggtcagagaagtagccagggacccaccttgcaggacatgtcatctattaaatcttggtgatggctccgatcccacggaaatacaaactaccatcagagaatactataaacacctctatgcaaataaactagaaaatctagaagaaatggataaattcctggacacatacaccctcccaagacgaaaccaggaagaagctgaatccctgaatagaccaataacaggctctgaaattgaggcaataattaatagcctaccaaccaaaaaaagtccaggaccagacggattcacagccaaattctaccaaaggtacaaggaggagcgggtaccattccttctgaaactattccaatcaacagaaaaagagggaatcttccctaactcattttatgaggccagcatcatcctgataccaaagcctggcagagacaccacaaagaaagagaattttacaccaatatccctgatgaacatcggtgcaaaaatcctcaataaaatactggcaaaacgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatgcagaaaaggcctttgactaaattcaacaaccttcatgctaaaaactctcaataaattaggtattgatgggacgtatctcaaaataataagagctatttatgacaaacccacagccaatatcatactgaataggcaaaaactggaagcattccctttgaaaactggcacaagacagggatgccctctctcaccactcctattcaacatagtgttggaagttctggccagggcaatcaggcaggagaaagaaataaacggtattcaattaggaaaagaggaagtcaaattgtccctgtttgcagatgatatgattgcatatttagaaaaccccattgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattccttcaaagagaataaaatacctaggaatccaacttacaagggatgtgaacgacctcttcaaggagaactacaaaccactgctcaatgaataaaagaggacacaaacaaatggaagaacattccatgctcatagataggaagaatcaatattgtgaaaatggccatactgcccaaggtaatttatagattcaatgccatccccatcaagctaccaatgactttctccacagaattagaaaaaactactttaaagttcatatggaaaaaaaaaaagggcccgcattgccaagacaatcctaagccaaaagaacaaagctggaggcatcatgctacctgacttcaaactatactatgaggccacagtaaccaaaacagcatggtactggtaccaaaacagagatacagaccaatggaatcgaacagagccctcagaaataataccacacatctacaaccatctgatctttgacaaacctgacaaaaacaagaaatagggaaagaattccctatttaataaatggtgctgggaaaactggctagccatatgtagaaggctgaaactggatcccttccttataacttatacaaaaattaattcaagacggattaaagacttaaatgttagacccaaaaccataaaaaccctagaagaaaacctaggcaataccattcaggatacaggcatgggaaaggatgtcatgtctaaaacaccaaaagcaatggcgacaaaagccaaaatagacaaatgggatctaattaaactaaagagcttctgcacagcaaaagaaactgccatcagcgtgaacaggcaacctacagaatgggagaaaatttttgcaatctactcatctgacaaagggctaatatccagaatctacaatgaactcaaataaacttacgagaaaaaaaacaaacaacctcatcacaaagtaggcgaaggatatgaacagacacttctcaaaagacattcatgcagccaacagacacatgaaaaaatgctgtatcactggctatcagagaaatgcaaatcaaaaccacaatgagataccatctcacaccagttaacatggtgattattaaaaagtcgggaaacaacaggtgctggagaggatgtggagaaataggaacacttttacactgttggtgggactctaaactagttcaaccactgtggaagacagtgtggcaattcctcagggatctagaactagaaacaccatttgacccagccatcccgttactgggtatacacccaaaggattataaatcatgctgctatgaagacacatgcacacgtatgtttattgcggcactattcacaatagcaaagacttggaaccaacccaaatgtccatcaatgatagactggattaagaaaatgtggcatatacacaccatggaatactatgcagccataagaaatgatgagttcatgtcctttgtagggacatggatgaagctggaaatcatcattctcagcaaactattgcaaggacaaaaaaccaaacaccacatgttctcactcataggtgggaactgaacaatgagaacacttggacataggaaggggaacatcacacactggggcctgtcatggggtgggggaaggggggagggatagcattaggagacacacctaatgtaaatgacaagttaatgggtgcagcacaccaacatggcacatgtatacatatgtaacaaatctgcacattgtgcacatgtaccctagaacttaaagtattaaaaaaaaaaaatcttggtgatggctgacagaagccacactgtttttctgaactcattgactcccagctttatattgccttatccctgtttgactacaacaacagtattataaagggcagttatgatgtttgctcacgtttcatctctcctaacagattttaggtgatcaattccaagggagcattactaagtcctacataaacctgtttattccacagctactaacaaaatggtctgtacacagtacaaagtcagcaaataactcccaaaccaccctaattacacaaaaagaactagtcactgaattacactttaatgtataaaaagatgagacttcatagtgtgtgctcgtgtatacgcaaggtatgttaataatgttaatatgttaataaatacactggacttcagaaggctgaatcagtgccagctttaaggaagtcacctggggaagtgctacactaaacccaactactctgttctttcttcacatcggtaaaatgtcaacattatgtaagcctcttttttaaaaaaaatcgttttgttatgcttttttttcttcctggaatagtatgaccttattaatcatatttggcacagaatgatcttttgatatttatgaaaatcaaatttaccctcacaggataaaaatgagtcactgctgaggatatttaaaagaataagctcagattctgacggaacttctaaaaggatctcaacaaaggttataaacaaagcctttcaaaatgactactgtgttcaggactacacacactcacaggatttaaaatcgagttccaggaaaacatgccaaaagactgccctactgctgaacacagccaacaatgatgtacagtaatgcccccagatccctcacccagggaggggaaaaaaagacaaaactggagttggtctctttttctggttccatgaaacctctgtgctctaattttccttcttcctttctttttaaatttggaaatagtcagccaatggtaattactatagcttcttttcctgaaaagtttctaagataatcctaaaaatatgcccacatttgtcactaccccaaccaaatgatcaaagatattatcacccaaagtgggatgacctaacattaggaatcacataataaacacaaaatgaaacatgcagcattgacattttaatgttgttggcaaaatgtcttaccctaaacctaaccatgaggaaatattaagttaaatctagaatgagcaagactcagacaatcgcctgaattctctaaaaaaaaaaaaaaaaaatctatctatctacctatctacctacctacctaactacctatcgtgtttgtatggggacactgaggagatgttagccaaagtacacaaactttagacatgaggaataagttcaaaagatctactgtatgtcatggtgaccacaggtaatgataacatattatatacctgaaaattgctaagagtagatcttatatgttctcaccccatatatacacacacactaatgagtatatgaggcaatacatgctaattagcttaatttaatcacttcacaatgtgtgtgtgtagatatatataaaaacactctacatagaatttttacttgtcaattagaaaaataaaatacttaatcctttaaaaaaaatgggtaagtatcatgtttcaggttaaaagaaaagttaccatcaccaaacatgagacacagggacatcatgcaaccccaataggatgccctgagaagaacacaaattcttgccaaaaatgaataatcttaatttattcatgaggaaacattaggcaaactcaaaaataaaagacattccacataattacagactggcactcttctaaattgtcaagatgattaaatacaaatttatacactgattaaatacaagagacaaaggagacacaccaactaaatgcaacgtggaggcctcaactgtcttgaaccagaaaaaggacacttgtgagaaaagtgacagcatttgagtaaggtctacagattagttagtaataacataccagtattaactgtctacttttgttaactgtggtacagttctataacatgttaatatttgaggaagctgggtaaagcgtacataagagtgatttatactatctttgtaactattctgtaaatctgaaattactgcaacatgaaaagttaaattagtgttatagaaaacaaaaaacatgaatgaggtactctttcaaatttgaaaaaactacagatttaaccaaatgaaaaattaatcctgaactggaaaaacaaaatacaaaaagacggctacagacaactggagaaatccaattatgaatcatatattaaataatattactaaattcctgttaatattcttgggtgtgataatagtgttgattatgtaagagaccattcttgattcttagaaaacgtatgctgaaatattgaaagactcatctatattttgaaatgtttctatgagaaagaaggatttggggaatggaaggagaaagaaaatggaaggaatagatctttgtaaagggtataaaaatgtgtgttttactgctattcaaacttcctagtttgaatatgcctccccccagaagctggggggaataaaaaaggaattcacagagcagtggaaatacaaagcatctcaatcccagtggtgtacacccaagcaaaaagccttaacaaattaccttagtaataataaggtttcctgacacagaccccaaaacctccagtagaagaggtaagaacaaagagcgggaattagaaaatctgccactattttctctgtaaatttaaagagatactgtcaaataaaaggatcttaatcctctgaacttgtatttcatccttgcaaatgtattaaaggaaagtactgttttaggaactatttctaaaagagaattttattttataatatttgcatattctcccagttgggagaggataggaaatgtaaatgctttcttaaaggtgagaacgttggagacgaaactagggctatatattgtacaaaaatccccaataaaattacgacaaggttctggggtaaccatttaaattatttttaaatgggccagtgcttcaaatcaatagtgtttcactttgtgtttaatattggtaatcaaaaacatatatacacatatatatattacaaataaaagcattggttcaagtatttgatagtcaaattacatcccatcttttaattacatctgatataactactacttaaggaggttcgattttgttttaatgtttccacattccttcacgtctttctttttattgcactatatacttttaatagtcatttgatactaaacaatattctttctaataaaaactaaaattgagccttctaaattaaaaactacatgatagcagtggtccattaatatgttcaatagaaatattaccatctcttcaaagtcattattttataatagcatttttttaatttacaaaacataccttaaaaatcaacatattgctacgcaggtcaaagctcaggtaaagaaaacaaaacaaaacaaaacactattttttgacaaattgttttgctgtgaactgctatcagaaaaggccagaagtgatgatatgacaatcaatagcatcacattaattctcttgtctttatcaaatgtacagtaaattcaaataaggagatacaatttcatttggattaacttacaaatgctggccagtatgaaatcatggacctgtaataacttagcagaagattatttgccagattttaaacatctgttttctagagtggctacaattcatgtattttacccaaagatatttactttctacataatattaagaagaaaaattaagcatctattttttccacaatattttccccatatttgaattctccccacttattttctatttttttggctgtcagcacctgctcatctggaaaagaggaagagctaaggcagctacagtggagcaaggctcactggcaatggccaagccttccctgcagagtgcacccctggctgctcatacaagcttctataataggaggcaagtgacgcattttcttttaaccaaaagagatctaccaagaagggagaaaaaaattaaatacagtctactgtgtctattatagaaagctctttacaacatttaacagaaatgtttatacccaaaaggaggatatctcagagatcactttaggcatggcaaaattcaccaatttaaaaacacaatttttgaaaaaagcagtcttttcatatcatctacaacaaaggaaagaggagaaaggagatggcaaaaatatctatggataaaaaatcttctgtggatggagcagaagaagatttttctacataaaaatttcagaatagctcctttaggtaataaacacaaaaacgtatttttaaaataaaatctctgctgtttcaaaagaacaggcatcacctagggtactttaagaactgtaatattaatttaaaagtagaccaaaaattctgtgcatctcttatctaaatgtgaatactattgaaatttttattaataacgaaaatgaatctgattttcatttacattaaaaaattcaaagctacataacattttatgagctatgaacttgaaagcttcatggtattaaaagaggaactaaaatacattcctcaaactcacttaggacaaaagaggtcagaggcagtggctcatgcctgtaatcccagcactttgggaagccaaggcaggaggattgcttgaggccagaagttcaagaccagcttgggcaacatagtgagaccctgcctctacaaaaagagaagaaaattagccgagtgcagtgctgtgtgcctatagtcccagctactccagaggccgaggtgggaagatctcgaacccaagagtttgaggctgcagtgagctatcattacatcgctgtcctttagcctgggtgaccaagcaagaccctgtctccaaacaaaaaaaagaaagaaaagaaaaagacaaccatcctttgtaagtacatgggaatatgtcaaagcattctgacttttatgacaaatttatttaatagaaactagaaaaataattctatttgtcagaatatgtagtccaaattcaatcaaacctacaaaaagtaggttctaattaatgcagccactattgcagaggactctaaagaacttaagtatattgggaaaaaattctagtttctagacctcatatggtatggcacagtgagttcacaagacaagacagaagaggttgttatagcataatctatcttttctcatctaatcaaaccaaacactgctctctatcttctggtagttgtaacacaaaacttttcataatcaagtcacagtaaatatccaaattaccaagttcatcttgctccctccccaaatttctgccacctactaacccccatctgtccccaaaaatcatgtaaacatcaccaaaaagtcgctgtattcattgctataacaaattgccataaacctggtacctctgaacaactgaaatttattctctctcagttttggaggccagaaatccaaaatcaaggtgtttgtagtgtggttccttcgagaggctctgtgagaaaatctgttccatgcctctcacccatggcttcccgtggctgccgacaacccttggcattccttggcatgtagatgtattactgcactctgtttctgtcttcgcatcaccttctcttcttctgtgccttcctctttcttataaggaccccttgtctttggatttaagcctctctcagataattcaggatgatctcatcttgagatccttaattacacgtgcaagatgcttttccttccaggctgacatctcttggtgtctgttgggggggtgggggtggaggcggcatgccatccaacccactacagccactatctttctatcttctaggattaatcacatcctcattaccaacaaatgcttacttctcaaaagaatttcagaaatatgtcacatcacccttttgctaaattttgctttatttcacatattagttatctgggaattctttttaaattgatccactgtcttataaatccttctggtgttttttattagtcacagtgaaaaaggcaggcataatagagtaagtatatattaaatgttttggcctacaagaataacattttcatcaattaccaaagtagaaaacatggggagtcttacacattcatctgggcagtcttcaatttcactgtaacctatgttttaaatttctacctatcagaataaatactcttttaatgataaggttaaccacacaattttaaccaattcatatgcaagtatgtcttccatgttcaacactgagtttaatatttacattgttactgttgtttcattcatactctaagcatcatttagcatacataaaaggtaccatgagccaagattgtgccattgcactccagtctggcgacagagtgagactccgtgtcaaaaaaaaaaaaaaaaaaaaaaaagttccaaggaaggttactataacatgcatatccttaaatgaagtctactttttgaaagaatgacttcacaaaatgggaatgcctccaaattctctgaatcaaaagaccaaaaatttcagatttattgggtgatgcaagatttcattatcaattttggaaagatgttttcttaaacggctctttcaagaacagaagctcatctatttttttcataggaatagaagaaacaacacctcttcagctctaagttcaggctacccactaaccgcaacttttgtcccactgcagagaaacacaagaaaggtggtacaaagcctgggaaccctcttttttttttttttttttttgagacggagtctcgctctgtcacccaggctgctggagtgcggtggtgtgatctcggctcactgcaatttccaccatctgggttcaagcaattctcctgcctcagcctcccaggtagctgtgattacaagcacgcaccaccatgactggctaattcttctatttttagtagagacggggtttcaccaggttggccaggctggtctcaaactcctgacctcaagtgatccacccgcctcggcctcccaaagtgctaggattacaggcataagacaccgcacccaggcacctctcttcttcttccacttggggtttcactgtctgcatgaagctgttggtgaggacacacacatttaaatgcacgcataaaagctttaaaatatttgtgtaatcctttaggaaaatagatccaaacagtgacaaaaatgtaattagcacagtaacttaaaacttaagaactaccatcttcactgtctacgtaagctaaaaatagggcatacaggcatacctcattttgtcgtgcttccctttattgtacttcacagatactacatttttacaaattaatggtaaccctgcatcaagcaagtctattggcaccatttttccaacagtatgtgcttacttcatgtctctgtgccatattttggtaattttcacaatatttcaaaccttttcattattgtatctcttatggtaacctgtgatcattaatctttgttgttactactgtaattattttggggcaccatgaaccacgcccacataggatggcaaacttaaccaataaatgcatgtattctgacggctcaaccaacgggctgttcccccatctctctccctttccttgggtctctctattccctgagacaaaacagtattgaaattaggccaatgaataaccttccagtgacttctgcagtgttcaagtagagcaaagatccacacgtctctcactggaaatcaaaaactagaaatgattaagcttagtgaggaaggcatgtcaaaagctgagatcagccaaaagctaggcctcttgcaccacttaggcttagttgccaatgcaaagcaacgtttcttgaaggtaattagaagtgctactccagtgaacacaggaataagaagaaagcagaatagccttattgctgatatgcagaaagttttagtggtccgtaaagaagatcaaactagccacaacattcccctaagccaaagcctaatccagagcaaagccctaactctctttaactataactcttaactctctttaattctagagttaagtctgagacaagtgaagaagctgcagaagaaaagttggaagctagcagaggctacttcatggttaaggaaagaagccatctaccgtaacacagaagtacaaggtgaagcagcacgtgctgatgtagaagctgcagcaaattatccagaagatctagctaagatcactgatgaaggtgcctacactgaataacacatcttcagtgtagacaaaacagcctactattagaagaagatgttatccaggactttcatagctacagaagagaagtcaatgcctggcttcaaagcttcaaaggacagactgactcccttgttagggactaatgcagctggtggcttttagttaaagccactgctcacttatcattcccaaacttctagagcccttaagaactatgctaagttaactctgcttatgctttataaatggaacaaataaaacctggatgacagtgcatctggtttccagcatagtttactgaatactaaagcccactgctgagacctactgctcaaaaaaaagagttctttcaaaatattactgttcagtgacaatgtcctggttacccaagagctctgacagagacagacaaggagatgaatgttgttttcatgcctgataacataacagccattccacagcccatggatcagtctactttcaagtcttattatttaagacacacatttcaggctgggcgtggtggctcacgcctgtaatcccagcactttgggagcttgaggcaggcagatcatgaggtcaagagatcaagaccatcctggccaacatggtgaaactccgtctctacaaaaaatacaaaaattagctgggcacggtggtgtgcacctgtagtcccagctactcaggaggctgaggcaggagaatcccttgaaccggggaggcaggggttgcagtgagccgagatcacaccactgcactccaacctggcaacagagcgagactccgtctcaaaaaaacaaaacaaaacaaaaaccacatttcataaggctatagctgccatagacagtgattcctcttatggatctgggcaaattaaattgaaaaccttctggaaaggatctgccattctagatccctttaagaacattcatgattcatgggaagaggccagaatatcaatattaacaggagtttggaagatgatgattccaatcttcatggatgacttggagggattcaagacttcagtggaggaagtcactacagatgtggtggaaagagcaagagaaatagaattagaagagtaacctgaagacgtgactgaatttctgaagtctcattataaaactggaatggatggggagttgcttcttgtggattgatctggtttggctgtgtccccacccaaatctcatcctgaattgtagctcccataattcccacatgttgtgggagggatatggtgagagatcactgaaccatggaggcgggtttcccccatactattctcgtcgtggtgaataagtctcaggaaatctcatgctttttttaataaggggtttcccttttcccttggctttcattctctctggactgcctctacgtaagacatgcctttgctcttcctttgccttctgtcatgactgtgaggactccccagccatgtagaactgtgagtccattaaacctctttcctttataaattacccagtctcgcatatgtctttattagctgcatgagaacagactaatacatggacaaataaagaaaacagtttcttgagatggaatctactcctgataaagatgctgtgaacactgcagaaatgacaacaaaggatttagagtattacataaacttagttgataaagcagtggcagggtttgaggattgattccaattttgaaagaattatgagtaaaatgctatcaaacagcagcgcatgctacagagaaatctcttgtgaaaggaagagtcaactgatgtggcaaactgcactgctgtccttggaaattggcacagcacctccacactccagcaaccgccactctaatcagtcagcagcctcaacatcaaggcaaaaccctctaccagcaaaaagattatgattctttgaaggctcaggtgaccattagaaaatttagcaataaagtatttttaaattaagatatgtacattgtgtttttagacataatggtactgcatgcttaacagactgcagatagtgtaaacataacttttatatgcactgggaaaccaaaaaatttgtgtggcttgctctatcgcagtatttgtttcattgcggtggggaaaatctgttaggtatgcctgtaacttgaatggggactttgctagggatgcaaacaatatgccattgtctctttacgcaaaatgttgcctttccaattaacatgattttgccttatgccctgtttctaggaccaaatcaaggatttgaggaatgggcgtgaactactcatacctccaccaggaataatcgccaattttgtttcaaccaggcccatttttgcagaggaagctaaaacgaaagaaagaaaattaagtatcatccatatcatcacattcaaatatgacaacttgaaaaagttatgagatatactaaaatattgtttactaattaaattgatatcacaaattcttaaaaaaaatcacttaaaaggcattgttatggaaataagtaagcactctaaatgacatgtattaggagagtcccacaacattttctgttaaaaactgcttggcagtgaattaatttttgattcacaagaccaggactgtaactccattattagacccaatattgccaagacatatttggaggcatagatctattaattattcaggatcagcagacttgtcagtatctgacaagcccaaattcttcagttgcctgaatatagtcccccagaccaaagagcttaataggtcatatcagatatggcaacttttcaagaccaagtctttagttaccttctgacaaatagttttactattctgacaggtggacagggttcctcttttcatgtctgttttcatggctactttaaaacatcttaataacttctttatttgcatatccaaatatacttagactacttcccatattctaatttccaaaacctgtattctttcagaaatggattacatgtaccttagcttttcaatttaaaatccaatgatttcattacaagaaaataggttcctaaaatgaagtgaaaaggaggaaaaaggacacatggactagcaaccagaaatcccaagaaactgaatcatgttgacgctacattgttctaaaaatttaaaaaatcttttataaagatgaggtctccttatgctgcccaggctagtcttgaactcctggcctcaatcaatccttctgccttggcagctctgcttttaacatgcagccacatcagaaacgataatggaaagcaagagaagaacagtgacaactctgtgccgtctgctgtgcccagttctcagtctcagagcccgaggacacaggcagagctgagtctctatggatatagtgtccacaacgatgaatatgggagatcagtctacgttgctctcatgaggtaacaggtgtgtgggctgtggccaaacagtctgggttcaaatctcagttcagtcacttctttggggcttctctcccttctccagtttcctccagtgccccaaagtacctgctctgagggttgttatgcagatggagtgagtgaatacatgtcaagtgctagaataacactgggtgcctggactgcacacagtaagcagtgggcactaattcttttcactctttttctattcacctcataagatcctcagaaaaccattcaggaagaaagtggacttcaaggagattcagttatcattactgtagcaaatggtgatttagtacttagattaacatccacagattaattgcttaatcttcacaacagcaacagtcatttcccccatttcctctaaagaggaagatattggcctaaaaaagggaggacctcagattcttttcctttttttctttcctttttaatttttttttttttaaacagggtctccctctgtcacctgagctggagtgtaatggcacgatcatggctcactgcagcctcaaactcccaggctcaagtgatcctcccacctcagcctcccaaagtgctgggattagaggtgcaagccacgcgcctggtccaggacctaagattcaaactcagttctacctgacccaaatcctggcaagaaacaacacaagacttttttcaggtgggaatttcgaaaacaccattaggaccaacaagtgactttttgaaaatattctactcaacaacaggaagcagaataaaatatttaaaattacctgaagagtaaacacaaccttcacttttttaaattatgtttttaacaggattaattcttacctgctactcgtatatcacaggctaaagccagttcaagaccaccacctaaagcgagtccatctattgctgcaattgttggtactggaagattagctgaaatggaaagaaaattttatgcttccttaataagattattatctcactgtgtaattcatttttaatttttttctgtgaatttatgctttaaatgggagatcatatacagacttttgtatcccttttacctttaacaaaatataagcatttccatcattattcttcaaaacattatataattactgtatagtgttccatcacatgtatgtgcaatatctttaaatcttcccatattattgaattactttcataaacattttttgttgaattaacagaatcacagttctacgatttcttaatcttagagccagaagtctttcacaagatgtttggttcatacaaagttcaaattgaaatgacttatacataattgtgaaatttatgatcctttatgggctacttcagtgcttggaatgacagagtctcattcaaagaaagacatctgctcaaacaagaaagaaactgtccaagtagttgctgtggcattggcccgtgagctgtcatttagtgaggagccctaacattatgaatgggagctggaaaacaatcaggctcttccacttcagaggcaagatgccctgagaacctgctcacaagcatgcctggaaaggggtcagccagtcacagaactaaaagctcaacttgcttgaatccagaaattgagtattattttaatacaacttttgtaaattatgacatacagatttcattttcataaccagttcaaaaagtgactggttttattagttattctgaaaagcagaactctattaattttatttctgactatgggaatgtgaagcaaggctggccaatgttaatatataacagaaagtggattttaaaaaggtaatatcggccgggcgctgtggctcacgcctgtaatcccagcactttgggaggccgaggtgggaggatcacctgaggtcaggagttcaagaccagcctggccaacatggtgaaacctcatctctacaaaaatacaaaaattagccaggcatgatggcgggtgcctgtaatccaagctactcaaagaggctgaggcaggagaatcgcgtaaacccaggaggcagagattgcagtgagccaagatcgtgccattgcactccagcctgggtgacagagtgagactgtctcaaaaaacaaacaaacaaacaaaaacaataaaaaggtactatcccccaaaatctctctcttccattctgatatgtaaaatcccccagaggctcactccttgactccttttaaaatatacaaatttgctgaagtacactgagttttattcataaataaaggaattcatcacttattgaagatcaagtctgaaaaggccaggaaggagcacatatacacagctgccgcctgaagcactcccagaagagcaggcgtggaaggggcttttgcacaggcagtatttcactatctgtacctgtctgaacatttaggggttgggggtggggagggacttgaaaggacaggacaaattcaaaatgtgctttccagaacacttagtgaaaaaaataacagctatgtcagggtttgcagtctggaaatgagtttaatgtgcaaacaatatctagtgaattttatctggaaaaaagaaaagaaaaatcaataaaaatataaaacagcaagttaaactgagtccttcccaaggtcatcctgagctactacaagtagaatgtaatgactttggttaccgactctcaactcctcttccttcctaaaaacctgtctagagatcatttatttctagacctcctcaacctactatctctccaacctcaagtctcacccgtcagaagccttccttaggccttgctaaggccctccagctcacctcctttacagaccagcttctaagaggagtagagtaaacccatgccaccatacccattcacctccaaacaagcaagaccattcttgttccagttaccaatgacattataagattgtcctatagccagtggacaatattcagtacctattaaatgtactgcctcaaaagatcagagacatccatcctggacactccctccttgtattcctcccttcactgcctgctgggtccctcatttttcctgcctttccatctacctctggtaatttctcagccttcttcccctctcaataaaagctcttcccaggagatctcattctcatccacaacttttaccacctatactaccaccaatgatttccagatctctacctcaaacccaaacagccccctgcctgttggacatacccacttaaatacttcatgtgtccaaaccatttcttctcaatccttcttctaggctgtatttcagttagtagcacctccattcatcaagttactcaagacactcagaagtcatcccagatgtcctccttgccaatgcccttttctaccacccaagttctgggtcccatcatttctcaccagcaggaagtacctaattaatctccttcacctgcaatctgccacccttctatgcatcttctacctttcctgtagggtaatctttctaaaatgtaaacacagtcatgctattcccctatttaaaactgttcaatgatttattctaccttcaggatagaaatggtgtaaacatttagcatggcacaggaaggcacctggaactaagttctgcacacctgcctaatctcttccaaaacctcagatattctgttccagccccaaactacttaaaacagctccaaaagtctccattcaagactcaatatctgtatacaaggtgcagctctgcctagaatgcctagctagcccctacttgtctgtcgaggctcaaatgtcccttcctctatgcttacatggcactctgtgcataaccttttctatcagaacattcattaccatacagcccatatgaaacaaaaattaacatcacatcaatgctactcaataacgttcttactaatctgggacaaacctcacggtttttcactgcctcttcctcctttattatattaatcctggtattttgcctacttttcttttttttattaacttcttttgtttaataaagaaataaacatatgcagtcctatggagctaaagaaaagaaaaattgccaagagttctaagatggagagagcagaagcagagaaagagtgggtgctccctccctgctacgtaagtgctgaagtcactcagcaagtagctgctggaggccgtgatattatgaaatacatatttggtcttcatccctgtttccagacacacagctcttaaaacccttggaatctctggagtgataaatgcatctttcttatttctccaataagtttatactttttggaattaataaaaactatttttaagtctaataggaatttgagccaggtacagtgactcatgcctgtaatcccagcattctgggaggccaaggacgaacgattgcctgtgcccaggaattcaagaccagcctgggaaacatggtgagacctcgtcttgattttttaagaaagaatttgagaaattatgtttctaaagaggatgaaaattgtgtgcccttgagaagcttaacaattccagggcttgtttccttttgtgcaggcccacaccagggtcactgcaaaaagagccagcctaggtgccaagagacataccagaggtgaggaccagggcctgcagatggaagacaggagctccaagagcaagtctcaggcaccatatgccttacaatttgtaagaaatacgtaacacaaaatgatgagaaatttgggttccacatacaaaaagaacaagaaaaatgggatactaattctcatattattaaataggttaagcactggaactttaaattattaattaacataaattagccttgtagaaagctgtctataaaatgtttctaactaaagaattaagtaaaacagcttaattcgtattcaatgggtaattaaatattagtcattttacaatattataaattctaaggctatacatcatcctaattattccctaaaagatgtctgtcgtagtaaattttatccaggaaagtatgcatcatctcaaagcacatgccagtctgatatatgtggtttctttacatctagtatttcttctacttgggagcacttaataatcaaagagggggccgggtgcagtgtggctcatgcctgtaatcccagcactttgggagtccaaggcaggtggatcatttaaggtcaggagttggcgaccagcctggccaacatggtgaaaccccatctctactaaaaatacaaaaattggctcacgcctgtaatcccagcactttgggaggctgaggcagacagatcacctgaggccaggagtttgagaccagcctgaccaacatagagaaaccccatctctactaaaaatacaaaattagctgggcgtggtggtacatgactgtaatcccagctactcaagaggctgaggcaggagaatcgcttgaacccaggaagtggaagttgcagtgagctgagatcgcgccattgcactccagcctgggcaacaagagtgaaactccatctcaaaaaaacaaacgaacaaacaaacaaaaaaattagccagacatggtggtgcgtgcctgtaatcccagctactgggaaggtgaggcaggggaattgcttgaaccctggaggcagaggttgcagtgagctgagatcgtgccactgcattccagcctgggcaacaaagtgagactctgtctcaaaaaaaaggaaaaaaaatgttaataatcatagcaggaactcaataaaatacacctttagaaaggtagattatgaatttcaaagatctaaaggaatagcaaaatgacagttgtatataagcacaaataaatgaaacaggaactgcgaatccaacgagcaatggctattcccaacagcaagaggaagaaattatgactcagtatgttatgcaaccaataggatcagatactattttcagtttcgtaccaggaaatgagccaggtatgacaaagaagataataatcctttgaaatgctcctaaaaatataattaaagcaaacaattaaacagtttgctattttaagagggaaaaaagcaactgtaaggcaggcccctggttcacttcagtagtctgtaggacctgcagcctacgataattagactcaagggactatgaaagtggggaaaattaaagtatctactttcgattctcagataaatacaacacataatgtaggttatttgatgcttctagaaaaatatgaacaatttgattattaaaggaaaatgttagtgtcagacgcatgatttttttttttgaaacggagtctcttgctctgtcgcccaggctagagtgcagtggcgcaatctcggctcactgcaagctcctcctcccgggttcacaccattctcctgcctcagtctcccgagtagctgggactactggtgcccgccactacgcccagctaattttttgtgtttttagtagagacagggtttcaccgtgttagccaggatggtctcaatctgacctcgtgatccacccgcctcggcctcccaaagtgctgggattacaggcgtaagccactgcgcccagccccacaggatttttaaatttggttttgcttgaagaatagtgttcctacagaaagcagtgaaatcaagcatttcaagggaaaggccctatgtagcattatgctggaagtctgaatactaaaatctttcaagaagaatagaaataaaatctaagttaactgaaaattacaataaatacctaattatctttcattttggctaaaactttaccttcatcctaatgtatattctcccattcccatcactgaggtttaaaaaaaatcacaataacaaaacaagccctgagtgaggcctgcaggctggctgggctgttgctccctggaggcccacaccagggtcattgctgcaaacataataccacaggtgagagatgggagttcaaagtgagaagtctcaggcaccacagaccttaaaaggaacacatatccaaaagccaaaagtaacagtatttaaatatgacacttcgattctagcactaggttaaaatctaaatgaaatggaaaaattctacaagttgttgtgaagaaaaactaacagatgaagagcagcaacattccttacagaaagggtcattataccaagaacaaattgctggaagctagcattccctctcacatgcttttttatacaagcctgtcatagtaatttcaggctgtatggattcacacagaaaagaggactaaatttacttttttactaggaaaaaaagagaaaaactgcctagaaacagcataaaataagtaatcaatcctcgatttagctaaaaccaaaggcatgtgggcaacatggaatagggtccaactcctccctaatactgcgagtgatgcagagtaagaccatgagtggcaacagcatgaggacagcctcactgcagtgctgcagattttatactcaatgatgaaggcagaaagtaccttccttaactcttaacagcaccttgtacctaaagcttataggaaatatataacacaaaatgacaagaaatttgggttccacatacaaaaagaacaagaaaaatgggatactaatattctcaaatcattaaataggttaagcactggtactttaaattattaattaacaaattagcattgtagaaagccgtctacaaaatgtttctaactaaagaattaagtaaaacagcttaatgaagtaaaaaagccaaaaaaacaaagtacactggtttcttgagctttcataagcaagtactggtggagagatataatttaaaacttgtgcaccaagtaacagaggtgtgagtaaatctaaaattatagtagtctccacttacgtgcagtttcactttttgaggtttcagttacccatggtcaactgcagtttgaaaatattacatggaaaaatttggaaaatttcagcaatacattattcatttggaaaaactcagcaatatattattttaataccatactaggatattatttcctttagcatctttaaaacaacatgatagaatgtttataaaacaatctgatctgatataaatcagatgacttccttagtcaattagaagagaacacctataatttctttaaaaagcaattcatatatacctatgtccaggaaaagttaaaaaaaaattcagttattagaaaggacgtattctttaatataactaagggtcaacaatataactacacatgagcttattctctactttattactaacacgacccaagccagaacatcacagacatagtctagtctgagttcagggatgttaaattggtatactatgcttatgctgacacttcacgtctcaacaaattagtaaactggtgaagtcctaaattcagtcactgcttccatcaaatatatgccacataccatgttgaatgatttaagtgaagctacagaatgcaactgtggggagttcaaatgtcaaatcctggctcaatgccaccactgttaccactgtgagccctgagaaaagttgcttaatttttctaagcctatcatttccccacctgccttcctacctttctatatatacgcttatgtatctagcaaatacttaaaaagtttttactatgtgtggccactgtcctaagaaccttacaaagattacttaaacttctatcagccttatgctgtaagaactcatgactttcaatttatagatgacacactgaggcacaaaggagttgctgttacttgcctggtacagtctgagcacaggctgtctggtttcagggttttgctcttaaccattactgcctatcactagttctcacaccccagatccccaacaccgtaagccatccttccatccttcccctaaggacttgtgaccacgtacccgagaaaagggaaatgctgaaactcaataggaagcccgacagcacactggctctgtgcgccactaattccttgagacctacggcaacaccacagttcactgggttcaactggggaaaccttgggaactggatgcaaagcaccagtcagctgactgtaatcgagttctgacttgagttttctctggaaacccccaaaacccacagtgtggcagtgccccccagtacacgactctataggctattaaaataaaaagggccaaccccagaatatttccttcctaccaaaattccaaatcaaaaaaccctccctaagggaaatgcacagatgacaggctggcagggaagtccatgcccattcagcaatcttatctggaaggttacacttactagtagaactgagtgatgacttctgttgattgctgttccacatttaacaaaactcttggcatttaaaatgctgcttaacatggtaaatgcagtcacttctatttctgataaaaagataacataccataagtagtttactttcacttggcaggaaaaaacctcaccattattgccttgcttcataaactctcaggctctgtaaccttgttatttagagtatggtttgtagaacagcaggattagcatcacctgtaagctttttataaatgtagactcccaggtcctatcgcagacccatctgaagcaggatctacatttttcacaatgcacatttttaacccaggtgatttatacacacaatacagtttgaggagctctggatacttaagctaatccacagggaacttgacagtctcaccatccataggataatatgctgatccactacattgaaaatgctactgaggaagcaacggccataacttgatccataaacgtaagggtagtgaaggctttacacacaaatgtctgtagcagctttatgtgtaacagcccaaaactgaacacaacccaaatgtctttcacgtagtacatctgggcaatggaatactactcatcaataaaaaagaactattgatcaaaaaaaagcgaatacatacaaaaattaatacatactgttgcattttcatgaaattcaaaaatatggaaattatagtgatacaagttcagtaattgcctgaggataagttgagggtagcagggaggggcaaaagaaagagacagcaaacggccatgaggaaatttctggaggtgatggacatattcattatcttgattgtggtgctgttttcacaagtcaaaagttaccaaattgtacactttaatatgggcaatttattttatgtcattacacctcaataaagctattttaaagaattatatgatctaattgatctgaaaatcataaagtcaacaaaagaaagtacactggtttcttgagctttcatgaacaagggctgatgcagagatataatttaaaatttgtacaccaagtaacagaggtgtaagtaaatctaaaattatagtagtctccccttacgtgcggtttcactttttgaggtttcagttacccatggtcaaccgcagttaaaaaatattacacggaaaagtccaaaaataaacaacatataagttttaaatgacacaccattctgagtagcatgacaaaatctcgcaccatcctgctccatcccttcttcaacacaataagggtgagtataatgcagtaaaatattttgagaacagactatattcatatgacttttattacagaatattgttgcaaattgttccgttttattcctagttattgttgctaatatcttactatgcctaatttacaaattaaacttcatcataggtgtgtatgtacaggaaaaaacagtatatacagggtttggtatcatctgtggtttcagacatccactaggggtcttggagtgcatcccctaataataaggggtcaactattgcataaagaaaacactaagaaaaaagggtgggagaagagaaaggtgggaaggaataatttaaaacaggaaatacacaaattctgtcattgttcaatagaactttctaaagaaacagtggatcaaatacactacgtaagtgtaataatgatgataaggtagtaccaaaatacaacgcttaacattattagaataaacccacacacagaacaaaccagagaagcacctaacatagttaagattatttttaaaatgtaaaattgccaaaatcagaagacaaagaaaagcataacgacaggcctaataccaaacacatcaatatatttaaagaagctgtatccatccactaagaaaaagattagccaggcatggtggactgagtagtcctagctactcaggagactggggcaggaggatcatttgagcccaggagttcaaggctacagtgagctatgactgtgccactgcacttcagcctgggcaagagagcgagacactgtctctaaaaacaagaaaactacatactgaactatgattcaaaaggagagggatgttaataactcataaaagaactgactcccagatgtttgttttcattctccaccattcttgatgagaggataaagaaaactaaaactaagatctgtaagtcaccatgcagaaaacaaagacagtaaagtgttctaccaattaatctttcacacaccataattcggcacttcaaatttctaataattacatcaaattaggaaaataaaaagtaaaatatatgctggattcaatctaataagctacattacatatttttagaaatctctttgaccctcaagcaaacaaaaaagacacagtgaacataaataaacaattcaggtcaacttggtggattgacaaaaaaattctgcaaactttgaaaatgttccttattaagcaattcttttttttttttttttgagacgcagtttcgctattgttacccaggctgaagtgcaatgccacaatcttggctcactgcaacctccgcctcccaggttcaagcgattctcctgcctcagccttccaaatagctggcattacaggtgcctaccatcatgcccggctaattttttgtacttttagcagcgatggggtttcaccctgttggccaggctggtctcgaactcctgacctcaggtgatccaccagcctcgacctcccaaagtgctgggattacaggcgtgagccacggcgcctggtcttaacttttatcttaaatgtattatgttaagaattgctggccaggcgtggtggctcatgcctgtaatcccagcactttgggaggcagaggtgggtggatcacctgaggtcaggagcaccaacccatgagggatccactcccatgactccaacacctcccaccaggccccacctccaacactggggattacaattcaacatgagatttgggtggtgccaaatacacaaactgtctcaaagacccagtagtcagttcttactgttcatcttacttggcctgtcaacagcatttaatcacactctccttcttgaaacattttcttcacttggcttttggaatactgttttcttcctaatgtggtatatatacaccatggaatactatgcagccataataaaagaatgaaaccacgtcttttgctgccccatggagctggaggtcattatccttagtgaaataactcggaaatagaaaatcaaatactgccatgttctcacttataagtggaagcaaaacaatgggtatacatgaacataaagatggaaataacagacactggggactccacaggggaggacagtggtgaagagggtgagaggtgaaaaattactgattgcatacaacattcactatttgggtgatgggttcactaggagcccaaactcaccattacacaatacatgcatgtaacaaacctgcacatgtatccccggatctaacataaaataagcacaaacaattaagaatattgttttcttcccaccttcctaccctgggtggcctttctcaatctaccgctttcattccagcctctaaatatcataatgcctcacagtcctcagacttttttttatctctacagtaaccccctaggtgtctcatccagtggtcatggcttcacatagcattaacattctgatgactcccaagttcacctgggtcaacctgcctcaactccgaattcatctgcacttggatgtccactaagcatcactaccttcacatatcaaacttgggactcctgagcgagaccttccatcccaatctagcaaaggatcagtcctaatttaccacaatagacattccaacaactgctccactcatgttcattctatcattctcagtcatgtcctaagagcagcaggagcttgggtagaaaagacagaggatcaaactcaggcaagttgagcagcattcttggaattttaggtagaggcagacaggaaagggattgcaagagaaggttcagcctgaagataagatgaaataattacagtatggctaacatgtttacaccaataagatataagccaatttgccctctcaatcaggtacctaccatgtgctcattactagacactaggtataagtgaagaaaaagccaactcatggttcttgcaatggggagatatggaaagtaccagatggtagagagaatccacattttctgattccacatcaagagatcaagatcaataaacttacaccaaaataattcaagagttcatcacattttaacaatgtataaaatctaaactgtctataacaaaataaaccatcctatggcattatctttgagaaaatgttaaactgagcagatcttgtgacctcctaagagtatcattacatgctgaaatataatggaacttcaagcttaggataaagatgacagaaagatagatcatgtggttaccaaaacattaaagaacactcatttatacaaagatagttaggctaggacagaagagtttgattccaatatcaaacctctgcagaagagaggccaagatgaaagtttgatatgtatgtgcatctattatactgtagtgggtctgttaattattagtgacttgttttgcattactttgagcctttcaataataaaattcaaatgtatcccaattctcaaactgaaagacatgctaacaaaaataaaatgagaagcactgcttgaaaagaggtttataccataaaacttacatcagatttttcacacagaattttttcattcagttatacaaagatattctttgtatttcaaagagagagcttttttcatagaaaaatgaatatggacagtagattttcaatcacatgaagaacagatccagagactgaaaatttccaaaattaaattatttctttctataaaaccttataaatgttaagaaaaaaattgttaaatacatgaattttgtcagctgtcccttttaacataattacctgtatttcaattcagctttgcatttacactgctaaattaaagcttttgcaattttatttcatcagagaaagaaaaagaagttatgaatgctggcattttaaaggattactgtggaagatcatttacaaaaacatgattgcctcacactaaattctgtaatctaaaattctaatgaaaacctattttaaatatttctttatcattaggtaacaattctttgatgtctcaacttgagagaactaggtctatccctttagagtttccacttagagaattctaaaaatgttttctatctcatcttgaaatatcatctaatttaaatgttactaagggcaagaatggccctcagtgaggtaattaacatgtccactccccatattctatactgctaatgtgcacaatatgggtcccaatagtgatgtcaacactgccaccacgaactactggaaggaaggtgcacaccaggaagccctagaaggaatggtaagaaacaacagctgttaatagatcctgataatttcattgctgtgtagccttgctgatgcctaatatttcaaaataatcagtttactgcttctaatccaggcaacctaaacttcaagagggaaggggacttgtaacaatgattaacattttagaaatctaaaaattcaccatttcctttgaatgaaacatctcaaaaatagtcacatgacttttttttttttttaaagaacaaaagaactcaattttattctaggattttactgtttaagaacagactttctaagatactaggaacaataaagtaaatttagtgactctgaatgaaatacagaactgctttctgatctctattttaataaaacagaagagctttcaaataagtcatgtctgtaagttgcttataaactctctttcattaaaaacacacagagtacaggaaatcacggttgccaaagagaaaatacatttgcctttcagatcccatcaattctccagttgtagaaaatgtgaatataacaggaggcaagaggggaaaatggtacccaacagacaagggtgaaccctgatttgtatcagtactaatactgccacaatttaaagatgcctatggttcaacagccagctcacaaaatttctgaacattaggctgggagtcatggctcatgcctgtaatcccagcactttaggaggccaaggtgggggtatcacttgaggccaggagttcaagaccagcctggccaacatggcgaaaccctgtctctaccaaaaaatacaaaatagccggcgtggtggctcacgcttgtagttctaactactcaagaggctgtggtggaagaattacttgaacgcaagaggtggaggctgcagtgagccgagatcgtgccactgcactccagcctgagcaacagagtgggaccctatcttttttttaaaacaaacaaaaaaaaattcctgaaaatttaacaatcacctggagtcagtgtgagcaggccccagtacaccactgccaaggcatttaattactggagggtctgtataggaagcaggcccgtaagtactgtcaaagacaaaaatctaacaaattgagttatagatccaattgccttttatttgtgattcatgaggcagggcagcctccattctacaaaatagaataaaagttcccatgaggcaatggcagaacagtgggttttaaagtaaggtagaaacaagaaaacaggacaagaggaaaaaaaactaattggttaacaggttacatcaggctttgcggggggggttgtttttttggcaagggttaaagcagagtagacttactgagctgattcaggtagactggaatctcctgctttcaggaaaaaccggtctgttttggaatccgtctgcttccttaataaagtttcaatttgattatgtggcattttgcaggagtgactatatcaatttaatctggtctgctggggatttgagcaggagctcagtccaaaacaatggcctcccataattttaacagtacaatgcaggatcctccaccatcagtatccatgaacatccactggccaagtcacttcctcccaagacaaaaataagcctagaagctcttctctcagaaaatgaacaaacttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaggcggagcttgcagtgagccgagattgcgccactgcagtccgcagtccggcctgggcgacaaagcgagactccgtctcaaaaaaaaaaaaaaaaaaaagaaaatgaacaaactttatgagaagaactagtgaaaagagagccagaaagaaagatggaggcctctgtgcagtatctggtccataaacgctcttttttttttttttttgagaccgagtttcactcttgtcgcccaggctggagtgcaaatggcacgatctcggctcattgcaacctccgcctcctaagttcaagtgatgctcgtgcctcagcctcctgagtagctgggattacaggcacgtgccaccacgcctggctaatttctgtacttcgagtagagatgggggttcaccatgttggcaaggctggtctcaaacttctgacctcaggtgatctgcccgcctcaggctcccaaagtgttaggactgcaggcatgagccactgtgcctgcccataaacgcattttgttagacatgcaaaaggatttttctctcccatcaaagagaaaaagtttcaagaaaagttttaatgtcaaaaaccttaaaagtagggggccaggaacagtggctcatgcctgtaatcccagcacttcaggaggccaaggcgggaggatcacttgagtcaaggagttcgaaaccagtctgggaaacatgacgaaacaacacaaaacttagccgggcatggtagagcccatccctgctactcgggaggctgaggtgggaggatcacttgagccccggaggtcgaggctacagacagctgagatcgcaccactgcactccagcctgggcgacacagggagaccctctctcaaagaaggaaaaaaaaaaaaaaaacaccttaaaaccaaaagcccaagagctatttttctagacatgtaaaatcttggcttcccttgaaaataatgagaaataaaaaaaaaaattctaagcccctcaaccaactgaactgaccttcttttggccaaggggaccacagagaaacctcagaggctgaattcgtagctatgatgtgatgggaggtcagaccatctccctcaatagccgccattaggctttcttctaacgggctaaagagaaaccagcccttgaaagatgccactgctgatttcaaccaacagcctgaatgctgccccgcccttctgccgttctgtcaaaacaaccaaccagcatttcttcctgataaagagactaccaaccacagggtggttctggcccatctacagaggaggcgcaatgagagtttttcgtgtcatctgcttcttcttttttgagacggagtctcactctgtcacccagactggagtgcagtggcatgatctcggctcactgcaacttccgcctcccaggttcaaacgattctcgtgcctcagcctccctaatagctggcactacaggctaggattacaggcgtgcgccaccacgtccagctaatttttgtatttttttagtagagacagggtttcaccacgttggccaggctggtctcgaactcctgacctcaggtgatctgcccgccttggcctcgaaaagtggtgggattacaggcatgagccaccgcgcccagccctctgtttcatcttttgacagcagaggtcccaagactccaccctcagatcctgctctggctgccatttgttacacatgggtcccacggaaaggcctgaagctcaaatgcgcatgtgcctgtttctcctttcataaatattcatgactcctcctgcagcttattgactatgtatacctggccaccctgctcagcatacattcctgttccctttaccccaccttccaagtggcagtttctggattctggccagaggctgtgcttcccagagtgtgggaatagccaccttgcaggctgtaaccctttatgagacataaagctctcctttctaaagttatgaaccttgtcattcttcagttgacagtaagaaagaaaaaaaaatacagtaaataagaaatgtccacaagtttcaagatagatgaatcttctaaaaattggtcttatttggcacatataaagaatatattcatatacatgtaataaagcataatcataataaactccaacacaatcaccactcaaagctagatctaggtcagaactaacacctgtctgccaccgagctcttcaactatccttccacctgaattccaaaccaaagataaccatccttgtaaagtctgtgtgtgtgtgtatatgttgattttattacacacttacacatccctaaacacaaactgtttagctttgaatgctattagttttataaaaaataagtcatactttcaaatcaacattgtgtttcaaagatttatccatattggtacatgtgtgtattattcatttatgtacactgctctctactatccaattgtataaatataccaaaatatttttccattctcctgtcatagaaatttggttgtttttcagctttttgctattaacaatgttaagtgtccctaggacacatgtgcaaaatgtctgcagaacaatgtggtttcaaatccaagtagcaacccattcatgagctagtcaagatgaggaattttttttaatgacacagggtagtatcaaactagagtgtacagacagaagaaccataacctttgatactctcccacccctatgtgtttactgggccagagtgtagatatatttcttactacaggtccaataaaaacagtctttaagttatccctctatgtaaataccccttaaaaagtgaactaccgagtcttatggaatgtggatattcaaatttgaaagacaatatcaaatacttttcctaagcagttacaccagttcagctcccattagaagtataaatcttcctgcctggtaatccacttaactcactaactcttagtaagacctggcttaagaatttttggctaatctggtggatgtaaaatggcatcccactgtggtcttaattgcaggtctatgactactactgtggctgaccatcttttcctatgtctaccctcactcctctacctctgtgtgaaatgtttttctgtcatgtcctcttgctgacttcaaggctgtacatatgtatgcatgtattgattcctgtatgtacttatcaatgcatacaagaatctttggccactatgtgtttcaaatattgtctcccagtctgtgtcttttctttctactttatttatagtatgttttcatgaattgatgttcttaagtttaatttggtaaaattgatcactgttttcttttatgtgtcatattttatgttttaagaaactcttctctctgttaagatcattgaagttttagtttccacttctaaacatattaagtctttgccattccccagcgatctgcaatgccacctctgtcacatatcaacttccccacttgggtggtcttttgggggttctatatttcaacccaatggtatacttatctatccgaaagcgaataatacaccgtcttcatttctatgtcattataataaatcttgagtgctgaaatggcaagacgcttcattttcttctttatgagtgtttggctatttgggggtctctttttgctcatcaagtccctcacaaaatcaatactgagagtctaggtgtaattacactgaattacaccatttgtgagaatcatctttttaatactcaatcttcctattcaagaggataatttgtctccatttatttttttaaacatgttacaataaagttttataatttctccaaatatgctacatgtagtcctagactcatttttgttcctactttccagggtatccttacttgacatcttttgtctgttgttggtataaagaaaggcaattgattattctgaatatggatctcatttccagccatcttgcaacactcttatttctaataatttattgtttcttttagctttttgatggagacagccataccacatgagaaggactctgttatttctttttcggtccttatttattgttgtttcctgcctactacagaaaccaggatttacagaataatatagaacagaggtggtgacagtgggtcctcttgccttgttcctgattttaggagatgacttctaatattttattgttaagaaagagatacctttcgtcaggctaaggaagtttccttctattcctagtttgctgagaacattttccatgaatacatgttgatatttctcaaatgctttttcctcaatctactgagatacacatatgactttattttcattggctaacatcatgagttaaaatttaatattttccagtggaaaccaccattgccttcctgggaaagcccaatttggtcttttgttacaatctgctggatttcatgtatgctcacaagtgaggctgtctcctcctattcctttcttccattgtttctctcggatttaggtataaagattacactagtctgaaataatgagttaggagtaaactctcactttactatcctgtggaactgtctgtataagattgtaagaatctgttccttatgcattgggtaaaacatcttaaaagtaaatctctatcatcaaaaaactgggtctggtgctttctctgtgaaaaagtttactataagaattggttgatcacttcagtgattatatgactgtaaccaagcagcttagcttcaaactgcttttagaaattttttttcctttcctcttttcatcccagtctcaagacacagctttgagacaaactacagatgtgttttcttttgtctctaaatacagccttggaatgtgctttaaaactccactcccctccctttcccaccttatgctttcatgcctgatgcacatgtatttacctggatgtttgttaagctcacaccatgctcacttatctggtcctatgtttccttagaagcttcaggggccaaatcctgatgcaaaccaggcacctccagaattctctcccgagcaggatattacttcaaggccagagttactcccggctagagactgacagcaagactgactgcgactgatttggcatggttgggcccaagatggtgctggccccttcaccagatggaacaataattcaggataagccataggagcaagtcatgccattgggcacctcccagcccccttgcctctcctgcattccaaatccctcttcttaaacccctgcactctccagaaattggaaagtggcagttttgggaaaggattctgtccactttcccccttgctggcaacaattaataaaattcacactctttatcatacctcactcttgttattttggcttctttctacaagcggcgagaagttggaccctcttttggttacatgactattccagcccatgatttcttcttgagacagaagtttcatatttattggcataaagttttttcccagtattttcttattatctttataatctctcctgtatctataatcacacctttttttcatttgtaatacgtattgttaaaacactttttactccactgtaaagagcacggccttgtgttgaccctaggcactgcatctctgtcttccattttactcatttctgttccttgtattgttgctttagttcaacattctttgaacttaaaacttttaaaaatctttttaaggtaatgcttagctatttatcatcaatgacatctccttgctaacttatggatttaatgttgtaaattcccctcaagtactgttacagtaggtagctaatcagacacgagcagagttggaaagggctccccacaaaatacacacaccaggaatgtcaggtgaccatgtaattgtcaggcggctgttaactgtctctctaaaataataattggtcacagccaacaccagagaaaggcagtctcctcgaaatatcaggtatttccagatagaaatacctgaaactggtgatcagcagcttcctgataagatctcaggagctgggcaagtgcagttgagcatgagcactgaggcaaaatggcggatgacgtccctctaggaacacggggctgcaaagtgggaaggtgcctcaagtaggcaggcctgcaacttagtaaacacactgcacgtgcagcccctcccaagggctggcaggccactgcgcatgcagacagcccaccccaagggaagaatcacaggagaagcaacagaagaccccagaagaatgccaacatataaaaccccaattcaaaaggtcaaacggtgcgcctgatctctcaagtcgtctacttgatccttgtgcaagttcctctccttcctgctctagagctctttaacaaactttcactcctgctctaaaacttgccccagtgtctcctccagccttatgcccctgggtcgaattctttcttctgaggaggcaagaactgagattgctacagacctgtacagattcactgatgctaacatacttgtgctgcatgacatggatacatcacagctaacagtaccactttaatcaaatctcatatatttggacatatggtaattgtataatcattcagttttagtattcttttccattatagtttcttctttgacccatgagctgttcagtattctcagtttacaaatatacggttttagaatctgtacgtatgcatatcttgtttctaactgttaaagcaaactaaatacggccttagaaagactctgtacttctatacttgtggatgaactgcaacctaacttaataggtagaaaagacagaaaacctaacttaggagtatgccctgtgacagtacctgaggcttggccaatcccagcagccatacttcaaccactcatacactgcccagtgttcaaactgtgttaaaataagacaaacgctgagctgtaaccaatccagctgtttctgcacctcgcttctgatttctgtatgtcacttccttcttttttgtctataaatttgttctgaccacaaggcatccctggagtctctctgaatgtactgtgattctggggactgcccgattcataaatcgttcactggtctattaaactcctttaaacttaatttggctgaagtttttcttttaacataacttaattccaccgtggacagaaaatatggtctctatacaccaattttctgaaatttaacagagaccttagggtcctgcacgtgacccatatctttaaacatttcttgtgttcatgagaatacataagttggggttgagtctattaaaccaaacttgataattatgttgttcaaatcactaaaaaatttttattaacttttgtctttttgacctcatggtaaattgagggagatgggttgataattttgtcagtgatgacaaattaccaatttatccatatcattttatgtgtgtatcttgagacttttgtttttaagtgcatacaagtttaagggtatgtttcttgaaaaattgaatcttttatcacatgcagcaactctctctctagtaatgctttttattttgaaatgtattttgaccaatatcaatactgatatatctttttttggctagtaatcttcaggtacaaaaagaggtatcccagatgtggctatttttaacaatattcagctgatgtcaattatttagtcaaatctgaacatctatgtctttaaaccgcaagtttaatcaactaacattaatagtgagtacttgacttatttcaacatcttactattcaagatgttctaagtttatgctattttttctctttacatttttttaagattggatgaacttatctttggtttttgttttgttttttcttgaactgttttgttttgttttctttgaattttatcaagaatacaaaacccccagatgcaatattttaaactccctatcaaagcgaagaccttaaaattaaaagctttatgactccaaaaagcaaaacccaatgacaaaggtataagccaagcatgcatcaagttgttcaaattagaactgaagtgagatttcttgaataaatatagaggaattaactccaaacaacaggaaaaatgaagataggagacaaatgacattcaaagaaaaatcagacccactgcctgttttagtacaaacctgtgagctaagaatggtttttacatttttaaatgcctggggaaaaaaatcaaaataaaaaattgtttcaaaatgcataaaaatcaaatgaaattcaaatttgggtatgcataaataaagctgtattggaacagagccacacacatttgttgatacatcatctatggttgctttcatactataaagtcagagttgtatagctgcaacagagaccatatggcaccataaaacctacaatatttactatatgacccttcaagataaagcctgcctgcctgtgatttttaacatattaaatgagtggattctattaagatactattaagatacttagtttccatatgtccttcaaaatgtctggaatcatcacagtaagtctactgtaatgttataataaaaagtatcattaataaatatggaggaactcccaagaaaaaatggagataagaactagcccagaaaagaaaagctatagctacaatcacaaaaaagaaaatgacattgcaaagacagaaagagttccagaaaaatcccaatttcagaatccacagaacagaaagacactctggaacaaacatcaaggtaatttgaacaatgaaaccaatcttagccacccccttgcatatatataaacttacaggtagcatcaacttttacttctaaaatcaagctctctgaccaacttctaaacaaagttcatgctctgtgtcagaaggtacataaacatgaggctgaagctggggagagaagcagggcctaaaacaataccagcacagaatgagaagaggcagaatagacagctaagccaaagacattatagaaatcaaaacacgtattttttaaattttaattctaagaaagtgagaaaacagtaacaaaaccacagaagatgcaaaaaggtgtcaaatggtcaaattctacaattctttcaagtaaaatgatttgttctgtatatagcatagaaaaacatggaaagcttttcacctcattctatgaagacaaataaccttcacaccaaaccaaaaaagaataacacaaaacaaaattaaaagctcaatctcctttatgattctaccaaaagcattttattgaatccagcaatatattttaaaaaccaacaccacccctaaccacaatgaccagacagagcttattctagtaatgtatggccaccgcagcattagtaaatctattaacacaactcagtataataaaggctaaataaggcaaacgctaacatacatcaattataatcccgatgcatattttaaaagcatttgacaaactttaatacttattcttgattaaaaacagaaataatctcctaacaagttgaaatagaagagaactgcctgaatatcataattactggcaaaatattaaaggcacccaccaaagtcaaagaaagataaggatgatcacgctcaccttaacaaatgaatactctatgagggcctgaaccaatatgaaaaaatatgaatatgtaaggttaaaatgttgggggaggagataaaaactgcattacttataggtaattacctatattgtacttttcaactgaaaacacaagaaaattaaagaagaattaacacaagtaattatccagctgacatgatataaaataagcacataaaagttattaacttttggccaggtgtggtggctcccacctgtaatcccagcactttgggaggctaaggcaggtggatcacgaggtcaagagatcaagaccatcctggccaacatggtgaaaccccatctctactaaaaatacaaaaattagctgggcatggtcatacgtgcctgtagtctcagctacttgagaggctgaggcaggagaattgcttgaacctgggatgcggaggttgcagtgagctgagatcgtgccactgcactccagcctggtgatagagcgagactccggctcaaaaaaaaaaaaaaacttaataactttcctacagactataataacaagactacaacgaaaacaaggggagggtctcattcaaaggaataaatgctataaaatagctaggaatatatttgagggggaaaaaaagatataagaccaagaaaagtataaaacttccttgaaagacattaaaaaaatgaatgaccccagaaaatacgagccatgcacactatggatagaaagatttactatcataaaaatgtcaaaattttcttaacaaaatttataaaattccaatcacagttgcaatacagaaatttttcctctttgccttaaaaaaataattctaaattcatttggaaaaactgatgtgcgagaatcaacagagaaaaccttcaaggaaaaagaataataaagagaacctagcatcatctagatattaaaagttttaaatttaaagatactggaatcaaattaagcacattagaggacaatatctataacacatttaaacacaaagaatataaaaatgccttttaaataaacaagtagttattaaataatcctataaaaggaggatgaagatgtgaaaggcaatttacaaatgaagaaaaggctgagtaatgtggctcatgcatgtaatcccaacactgtgggaagacgagggaggaggatcgcttgaggcaggagttcaagatcagccagggcatcacagtgagacccccatctctacaagaaaattaaaaatcagccaggcctgatggttcacacctgtagtcctaaccacttaggaggctgaggcaggaggatctcttgagcccaggagttggaggttacagtgagctattatcatgccactgcattccagcctgggtgataaagtgagaccctgtctctagaaaaaatcaaaaattaaaaaaaaaaaaaaactaaaaccaaataaaaaaaaaaaaagaaagccaaatctcatttgaaaagataaaacatcacataagcatttggggcaatacaaattaaaatgttgagtttttttttttttaacctaggcaaacttcaaaaatagcaacattatatgctggcaggaatgtgaggaaacatatactgtctttaaccgatgggaatataattttgtagaatttattaatactaaaatataaaatgaacaaatgataactggaacagcgattccctgtttaagaatctatgcttatgtacaagggtattcactaccttattataaataacataaacagaggaaaaaaatgttcattaatgaagaaataatataaaattttggataagactggattaatatacagcagtaaattaaaaataaaataaattgatagttactgtaagtcttaaaaaagtatgatcctgtatatttaaaaaacaaaggaatcccaaacgtatgtttgcatgtatatagttaaatatagatattgtaagtcaaaggcttatggcaaattattattgttgtctaataaataaataccttcatattttatcatacataagacatctgtaattattaaatattttacataatttttcaaattaaatatattaagtgtcacgttaaacagctataggtcatgattatctaattatataaatatttaaccaatgcttatatataatgtgtaactttttaaatgtgacatttaagaaccccttcggcatgctgaaagaagaacttaatagtgcttaccaatatcgttaatcactgctcttattttggagacaaaaggaccaacttcactggaactcattttggctctttccttaaggtcagcacctgcaaagtattttatttacaaatataatctagttgtaaacaaaattttaaggcaaagaattgaaaatttacttaagattagtatacaacttcaagatcagcctaattcatcttttaatagaatgacattacctcagttttccttcccaatgaccatgttcaacaagaataaagtatttgtctattcatacgtctaccatgtgcttaaagcggtgcttctccagctttccagtctcaggccccttcacgctcttaaaggaagacactatagttggcatctactgatctatagttactctattagaaatcaaaactaagaaattgtttaaatgtttattcatttaaaaatacaaatgaacccattaatgttaacataaataatgacaaattggtgacaccaccttgctgctttgcaaggtgctgtcagtttatccaccactgcttttgcagtgtattagcacaaatgccaacccagtaaaaagggcagattacactttggtcagtccttttgacttcatggatgcctgccttggggactgtcaaccacaagggagaagcatagatttaaagtatgaacaaactgatgatttcataattatgactttagcacagaatcgtaactttggaacagagaaaaataaacacatggaattccttaagggataattaactctgagaacaaagaagatctttagcaaaattaacaatctgaaaaaagatgggtccccaattaaacaaacagacgaacaacaaagtaaaattacagtatagaaggcatacactcagctatttacccttattagtctattacaaatcaatcatgctgatacataatataagtaagggctagggcaggggcattctgatctcacacacttccaggggagtgagaacctcagttgacaaagcacatatcccagcatccatcagatcttagatatgtataccctagaaaatctctcaaatacccaagaaaatatgtacaataaaattcaagggagcatacaaagactagcaaaaaaatggatataacctaaatatccatccataggagaattaataaaacaaggacataattataaatagaatgttacctgtataagcatgaaggtgaaagaattaagagtaaatacagataaatccaatgaataatattattgaaaaagtattaattacagaaagatacacaggataatgaacacaaattttaaaaacaataatgctattcagggatataaaacacacagaaatgataaattcaattggtggttatgggggctggagtatgactggcaatgggtacacagaggacttcaattttatttgtaatattgtattgcttaggttgggtggtgggtgctaaatatgcaagtctttaaatgttttggaatgcctgatacatgtctttgtaattaatttttccatgaagaattaatatgtaacaaagaaaaatgttggcagaaccaaaaacaaataactggcttaacttggtgccaaactgttctttgaggcccagtatttctcagttccattacttcataaatttaaatattttacatttatgaccactcatctcaagtgggccattctgctgcccagcaatcctactgtatttcctgagttcattcactctcctactcacatatagaccacttcacaacttccctctccacgaatcttaaaacctcctatcaatcctacgaaaagccagaaaagacattctaccagtacttaccaccaaagctatccatccaggacttgaacctatatactccgccctgcctcctgttaccatgaatgaactaactcattgagagtgacagaagacagacaaattccccagcagacagggatgtgtccccagtgaaacccaaccttcaagccactgacagtttaaagtctaaaaaccgagctgctggtttgagagagtccataaacagagagagaacttctatccccatattaccctcactctcttgattggttccttctggatgatgccttttaaccaatcaaacagtgatttttccaagcccacccagggatgaatcagcacacacacctccattctaacccataaaaaccccagactcaccctctcaggtggctacccactttgggtcccctctcacagctgagagctttccttatgtcactcaataaaattcttctctgccttactcactctctggtgtccacgcacctcattcctcttggtcgcgggacaaggacctggaactcgctgagctgcaggcgacaggaatgaaagggctgtgatgcccctggccggctcgccaagctgcgtgcaacgggaataaaagagctgtaacatgctcccgctagccaagctatgggagtgaagagctgcaacatttctggggtcccagacctcaggactccccgagcaagagttgtaacactgcttggggctccatgaatgctggttttatctctgagtttttgggtgacaccacattccccttgtctagacaccggtgcctgacatggaagtcattcatggcatgcccagtccagcctcaagctgagtgtggaggtgcagcaggcacgggattcaagtgggcgcgaaccaagcacaacctgccaggccaagagggtggagtaaggccagggggcccaagcaaggcccagacagaggtggcaggggcagcaaagatttctggctggcaaagtggcactgaaggaatcctgtaacatcatgagggaggccaatccatccccttgtgcactggattcaaccccttctaatctccttggggacatcactcactccagcacttacgcgctctccttggctggcatcaatactacccctccttagaggttcgttcccatcagcatatagcaatgctgtaatactgacatcttaaaaaaaactcacatagacttccactgttagctatgatggaataggtcatcatcagaccaattcctccatgaaatactgcagaaaatatgtaagacagctgcttgagcaactaaggcagccaggatgtaagaggctggaaagccagagaagggaaactatggtaagcctctgctttcctcccaaaacatacactgagttataaactggtcgggtaaagagggtataaaagccgtagcacgaagcagcagctcagaaatctctgtaatctcctggaagtggggagacaaacactggcagtgaagactacaggctcagccagaactttgaggccaagatctcggagaaaaaggaactaccaacaagagagcccactaaagggactcaccaaattaatgaaataaaggtgaaaatcgtatacattttcattagttacagaaaaagtatttgataaaattcaatattcattccttaacatcttcactgaagaataatttacataaaatagagttcagccactttaagtatagaattcaaggatttttactaaatttacagagttgtacaaccatcacctcaatctgatcttagaacacctccattatcacaaaaagatctctcatgcccatatgcagttgctccctgtttccatcccagcaccatgtaatcactaatctatgttcctaagaattggtcttttctggacatttcctataaataaattcatacaatatgtggtctttttttgtctgttttctttcatatggcttgcttttcaggttcatgcatgttataagcatgaagtattccactgtatgaacatataaacgttttgcttatcccttcatcggatgacagatattcatatcattcctactttttggctactatgactaatgctgatatggacattcacttacaagtttttggtggacaaatgttttcatttgtcttggataaagacaaagtagaattgctaggtcatactgtaaatttttgtttaacttggagaaaagaaaaaaaaaaaacaaaaaccctgccaagctgtttgcctaggttggctgcaccatttcacattcctaccagcaatgcatgagggtctctgttttcctagtcaccaacaattgtctgtcttttttattatacccattctagtgagtgtgaagtggtacctataaggattttaatttgcatttccctaatgactaatgaggttaaacacttttcatgtgcttactggccattcaaacagctgctctagtgaaatgtccattcaaatcttgctcatttttttaaaatcaggtaatttgttttctccttattgagttgtaagttataacttagatacaagccctttctaaaatatatgatttacaaatattttcttcatttttgtgtcttgcctttcactttcttggtgatttttgaagcacaaattttaattttgattaaaattaatcaaaattataaatttttatcagttgtgcttttctggtaatatctaaaaatcaacactcattcctgattaaattatcttagcaaattaggaagaaaagggaatctttataataaaaagtaactgtaaagtacctatagctaacataatctttaacagtcaattactaaaagcttcctcccagggaccaagaaaagagacaagggtgttccctaacacttttaaacactgtaacagatgtactagcgagtgtgataagaccaaaataaaacttacaaggattgaaaggtataataaaacagtcattattagcagataactgtatatgaagaatagcctaaagaattttcaaaccatgaaaataagtaaatttagtaaggttgctggatataagctcaatatacaaaaatcaactgtatttctatatactagcaaaagaaatttgaatgtgaaatctcgaaaagatatcactttcaaaacatccaaaaatcaaggagtgaaagaataaatctaacaaaaggaacataagaccttgacacaaaaactgaaaaatcttactgaaataaagaagccccaaataaaagaacacattacattcatgtgttagaatagttcatactaaaagatgtaaattctctccaaattaatagattaaatgttgttccaataaaaatcccaatttttctgaaaattaataagatgaaaatgcaaagtgccaacaacagtcaagataccgcataaagtattggtgaaggtgtaaagcaatgagacctctgacttaagactgctaggagtaaaaccagtacaatcattttggaaagcaattccactccaaatatacacactcaacaaaaaatgcatgatgtgtactaaaagacatgtacaagcatagtcagggcagcactattagaaacagctaaaagctgggaacacctcaaacaacaagcaaacagtagaagacacaaattatgaaatatttctacaaggaacaggactgcactactcctagacgaatggtacaggctgaatcctgcaaatatgttcaatggaagagatcagcctgcaaaattccaactacataaagtttgaaaataggcaatattagtatttggcgataaaagtcataataattgcctatgtcttttgggtgggagatgggtaatgataaggaagggacatgtgggacgactgtggtgtgctgggacttcattttgtagaaatttacagaattatgtgcttttaatttgtgcaattttctgtatgtccacattatacttcagttaaaattttttttaagtttcctgattccatacgccctaccccctccagctgccaattttttcctcctttttacgccaaactcttcagaagacctgcctcccatgctctcctcctatactgtctccaagcaagggagacaaaaagagtaaaaaataaacataacaaattagtaatctacatagaaggggataaatgttttggagaaaaaggtgaagaaagtacagacgggtattaaaggtggtgaccatgtcacaatattcgatgtcataaataccattctatttgagaatgtataataagctttgtgaatggcagtatcatagccaatgaggtttatctgaggagagattattctaagagaaagtataataagattcaataagatttcatatgttccttgtatttcaagtgtatctaataatttaatacctggttctcagacattttaaatgaactttatatctcctgttacatatttgtatgtaacttgccagtaataacttgtattgcttttgcattatctactgcaaactcttttcatttaaatatatagttggaaatgtataatacactaagtagacaacgcatggaattgatacattatttaacaattttgagaaaacatatattttaaacaccacccactataatggccctctcctaaaatttcagtgttttaataaattccttcttttaaatattctttaggattagtatgtattaaatttctatacttatatttgcagtaaactactccaatgaactttagagaagttatgggaaaacacactattctctgttatgcactgcatgatgtctagcttccttggcccccactaaccatatgtcaataaagctcttcaacagccaaaaacgtccctcaaattccaaaaggctccacagtgggtgttaacgtccccttgagatctaatgctttaagccagtgatcttcaacctttttgttcctattattgctaaaagaattttgaagtatgtgctcctttgaacatttttatgctgacatttgaaatttttcatctaagtttaagtagtttgaaagatttcaatgtactatgaacactcacatttttaaacaaaactcatatgccattttcaatgaatccagtggaacctacactatcagtgatttggttctcaaaatcatccgcattaaaacataccgcatttaaaacaagctgggcgcggtggctcacgcctggaatcacagcactgtaggaggctgaggcaggcagatcacttgaggtcaggaattcaagaccagcctggccaaaatggcgacaccccgactctactaaaaacacaaaaattagccaggagtggtggcgggtgcctgtaatctcggctacttgggaggctgaggcaggaaaatcacttgaatccaggaggtggaagttgcagtgagccaaaatcgcaccactgcactccagcctgggcaacagagcaagactgtctcaaaaaaataaataaaacatacaaacaaacctatccttaaaaagtgtaaactgaagaatgaggaggttcataaacttggaaaggagagttttatttctcataaatggttgcggcttgtgccatactgacaggctggggagcacagcttttggccagaagccagaaacagacacttcaagggaaaggcaaagggaagtggaatttatgatgaacgaggtggctgaatatacatatttaacaagttctaagagtcatgaatattataaaaggagaaatgcgtgcgcacaattgagcttcatgcactttcatgggtcatgtacaaaaaatgggggcgtgagcatggcccgagggcagagttttcagccctctgctgtcaaaggtgaagcagaggacacaaaaaccctcactgtgcatccttcgtagacctcccagaaccactctgcggttctcgctctcttatcaggaaagaacgctggtaagcagttaaaactacaaaaggcaggggcagcaccaggcagtagatatcagcagtggagcaagtctttccaaagggctggtttgtttaaccttcaggaaagaaagcctaatggcagttctccagggagggggtattacaagagatgtccgacctcccatcctgtcatggctgagattttcctcggccaaaaggaggtcacagttgtccaagtcagttggcttagcatttcatttttatttctcaatataaaaaatgttacattatctcctttcttcattaactggtatttttgctctgctttcaattttttttttcctgatataactggtatttgtgctttaaaatattttatttgtcattctgtcacatttctttgcaacaaaatgtgtatgcaaattaaattaatttttattaaattccctataaagtgccaagtttaaaagttttcttctggattgaattttcattacaagtattattagcacagaactgacaaaagcaaaaatatatttcaaatttgataactattaaatactaaatataaacttttattagacatgcatcacaatgagatagatgggactaccttccctcctctcattatttcatatattcatgaatgagtattatttactgctagagtgaggcaggatttaccatcaattttactcatgctgagaaaaccttttcacataaacaaggaagatgtttactacagcaatgtcattcctttagcactctggtgaaaaaatcacatcgtaatcaagaaacatctaacaagttcccaacaattctagtaaactgtcttcaaactatgttgaaagcaaagaaccagaaactgccagaataagaatctcagctgaaattctcaacattaatattttaaaggcctcttttttggcaattcataggcttttttcccctccctgtagcaacaaagcaaagatcaggaataactttccattgtggaagaggcaactatgaagagaaagagaactggaacctccagttcagcctgaagagttttatgacagggtacacgttatgtattagacagaccctttatgtattagacagatgtgtgcacctcctgaggcctagaaacatcccagccccagccaggggatctctgtttttaagtcacatcagtcagaagtcagttgccaggtcatatggaatgcaaagtggctgcacatccacacactgcctccagtacacggcattgtcatacttgctgtgatgactcactttatgtgtctacttgtctgggccacagggtgcccagataaaatacagtttcttggtacgtcagtaagggtccttctggatgactagcatttgaattcgtgaactgcaaagaagcagcccttcccatgtgggtagccatcatccaattccctgagggcctcaatagaacaaaaggtgaaggaggaaggaactggcctctattttccgccccactgctagagttgggacatctcatctcatcttcccctgcccttggactagatttacactggctcccatgaatctcaggcctttggacgcagactgaattacaccaccagctttcctgggtctccagcttgcagatgtagactgtgggacatttcagttccataatcccgtgagccaattcctcacaataaatcttttatatttctattgatactatttatctggagaaccctaatacacttattaaattgtggcaatctagtgaatgagaaatggtaattttaagttgcatttttctcagaagtaaaagatgaaatgcttcacaaaattgtagggggttattacgcagtgattaaagtcatgatttcaatcgttccaatttttgtacatgtggtgccaattcgaacaccctggtctcttgatcccactccaaacaggcttttattctctccaataaagccaaataatcaggtcaagataaccaatgatttccatgtggctaaatccacatcttaacctgcaagcaaatctggataaagcggggattctcctgagtcctggaatatctccaactaggaccaggaaactagtctgtttttctttcccgctgctcttacgtggtggttgtcaggggtaccctagcttcataaaatgagctggaaaagactctctttttctattttctcaaagagtatataaagactggaattatctgctccatgaatgcttaggtgtaaatgtaacattcttctgaagtcattgtggcccggtgctttctgtgtggaaagatctttaactgatgcttcaatttccacattgctctggtattactagttttctatttcttaagtcagttttggttaatttttattttctagtaatttatctattccacctaaaatcttgactttattgcacattcttaacattatcttaccagtttaatctctgtggaatttatatctatggctcccttttccaatctgaatattgtgtattttttccctcactcacaattaatcttgccaaaagtctgactatttggcttttcaaagaagcagctctaggctctattatccttactacttaatgtgttttccatgtcattagtttatgctcacttcatttcctttcatctaccctatttgggttattctgcagttattttttcacttaaggtacatgcttagtttattcattttcagccttttttctttcctgaagtccaaccttagctatcttatacaatttttaaagtattttttgttagcatttagttctgaatgctttctaatttccattaagattcatttgctgagctgtaagttatttagaagttatcttaaatttcccaatgtaggggactttttctaattacgttttttgttaatgacttctaacaactgcctgtggtgacagaatgtggtctgatgatagctgtcctctgaaatctgtggaggttttatggcctagcagatggctaattttcataaatagtccatgtgtgcctgaaacgaatgcctagccatcaaccactgtggatgaatgtccacaaaggtatattacattaaccctcagtagaccaggaaaagtaaccaacactctatcagctggggccaatggactccttagatctttatttcatatttaggtcaatttacaaacaatttaaagaaaaataatagtgaaaaaacaactttattagaaattttagtaaaaatttaaacataaaaaacccacgttgctattttatattttcctggcatatgcatatatatgtatatacacacacatacatacaaacacatacatattataaatatacaaatatatactcacatacatacacaaacacatctgaaaaaggctacatcatttgaacgaaattgttaacagacagaaataaacctggattggccaggcatggtggctcatgcctactcccaacactttgggaggccaaggcgggtgaatcacttgaggccacgagtttgagaccagtctggctaacatggcaaaaccctgtctctactaaaaacacaaaaataagctgggcgtgatggtgcacacctgtaaacctagctactcaggaggctgaggcacgagaatcacttgaacctgggatgcggaggttgcagtgagccgtgattgcaccactgtactgcactccagcctgggtgacagagcaagactcggtctccaaaaaaaaaaaagaaatgaacctccatcacacagactcggtctccagaaaaagaaaaaaaaaaaaagaaagaaaaaagaaatgaacctggattgcacaggtttataaaagctgaatctaggtttcaaatacatctctagcagatcatcattactatcactacttctggttcttcttggacttgcactgtagaaatgcaatgtttttgaaaacactgatggctcttaatttaaagaggacagccatattctttgctccctaattgcaatatactttcatttttagatttataaacatcagtcagaatgatcaagccaatgacttgttttcatttctatgccatctatttccttcttatcacctttgtatacacaagggccttcaacacatcatttacaagctgtatcaagtaaatgttcacatataaacatcatatgagatccaacaatactatcgcacatcctcttggcaaaatgggatggtccctccccactgcccacagagcagagattatttctctgttatttactgctatatcctcaacagtacctgacacatggcaggctctctctaaaaaatattaaatacatgaattaattaatgaaattcatgtgttttctttgtagttgagatctgatgaagagttacagtaaaaatgcttaagaggtatgaatactaaccatttaccttaacatcctctccaacttacctcctcctatttcctgatggcagccttttgttctggtgccctcccaactccccacagtccatatactttggaagaagatgaatctacccccacatccaggagtggactatggttagtttgagctaaccagcatggtccactcccctaagcaatcaaatcaagctcaattgaagggctccagcttggattgcagcagagtattctctttctttcaagaaagtcatgcatggatatggggcccagaactgaagttttaggccaccaacccatatataaagctggcaaacagagtaaactacaggaatttcagaaaaattcaaaatgactggattcaggcaatcctaacaggcttatagtttaagtcaatttgtgaaaatgctttgttagatggaggtgagagctcattatctaactagatgacatattagaaatgattacaaattggttctgcttcagtccacatctgttctcaagggaaggaattgattggtggagatataaaattagctctaatgattacagaaagtttctaggtaatgtctggagaggatcaagtgagattaaggagcatgaccttcttggtataacatgactactgtcagagcttctagagcactagatcctcaataagaataccaacttgtaagtgctttcacttatatcctcatccagaacctgcacccaccttttactccaattaaataaaaaatttctatcttggaaactcaaccagtaaaattttacctgcccatttgatgaaaaggactattctgccacaggatttctattagaattcaaggctctaataaatcagatgtcacttttcctcaaagtgaagtgtcctttcactaaccaaaaccaaaaccctccatttctgtccagcgtctcagcccctcttgaaggcctacttcgaggcttctttctgaaacgtgatgacacctctccctcttcaataggatcagattagtttcatcagcatgcaaactatagtaacacctccatcctgaaaaagtctcatagatccctcatacacttccagccatcactacattttaatgaactaacagagactgatttctaggaggtactttttttttggcagggggacagagtctcgctgttgttggcctaggctggagcgcaatggcgcgatctcggctcactgcaacatccacctcccaggttccagcaattctcctgcctcagcctcccgagtagctgagattacaggtgcccaccaccacgccctgctaatttttgtatttttagtagagatgaggtttcatcatgttggccaggctggtctcgaactcctgacctcaggtgatccacccacctgggcctcccaaagtgctgggaagaggtattgttaactgcaaaaactcaagtgcaagaatatatataaaatgctactagcataagaaagattggaaatagttgaacaaataggtatagccttaattttgcagacagaaacatgaaggataatctagaaactaatgagactcactaacaccctcaagggtgggaactggagggaagagattagagggaggaagtgggtactgacacttctatgattatatctctttgaatagtttagacttctgaaaccatattaatatttcatatatcaaaataaaataaataggagtgaggaaacctaacattacctctaatgaataaaacacaaccacaataaagaaataacctaagtaactcttcacacaatatgtttagtattgtatattacagtattacataccttcagtccaaagatataaagtacagctactccttgacttgcaatggggttatatcccaataaactcatgggatgttgaaaatatcacaactggaaaatgcattttacagatgctcctcaacttaaaatggggttacaatttctactgaatgcgtatcacttttgcaccatcgtaaattgaaaaatcgctaagtcaaaccatcattaagtgagggactgtactgtcaataggtaataagctctggataaaaggtatgtttaccacagtggtatggatcagcaactctgaaattactttcagtaagttacaggattgagcaaatgagtcaatatactgcaggtactacaaatatggaaagggagaaggtaacaatgaaccctgtggtgataaactggaaatggaggtaacaatataaactcatggttttcaacatgtaagtacagaaatggttgtaaacatgtgtgtgtgaatatgtaatgtaatttatctacttatttcttaggtctgtcttgagaagcaaagacacccatgtaacagtgagcacatgttgtacccagatcttggttcttcaataccattccccactaataggaactaagaacttgcacctgtggctgcaatggagtaactggtactggatcccctccctcaaaatatatgaaatggctcagctattgatcaacaggcagtaaaagactaccatctgggatcctgtgactgtccctgttttcttcctgaagacacctgacagactggtagaaggcaggggtaccccaacaaagcactgtggtcttgctgatcgagatcagcgtgcagggaggctgaggtggctggaatttacagggcagataaatggaaaggtggggtaacctctcagaggaagagctccagtaaaatgcactagggttccctaatgcttaggctgaacagtaaactcccaattcatagaaaattactagagaaagaaaaaacaaccagggagctatgaaatgaacaaatcctagagattacactgagctgaaaggcattcacgctatgaccagcaggaatagagagaacttgtcaacacctatgtccagctggactgatcctccaggacagtaactaccttctgcagcaaaaccacactgaataagaaagatacctaataggcatgtgtcctatctgtcacaaaacaaaaccaattgacagttatttcacataattctaaagaaaaaaaattaccaaatgtttacagtcacaaaaaggtaacaaacataatatccattaatataaaatttaatgagtaaataatactggtattaatcatgttgcctttttctttagagaatgtaaaaatattgactacctccatctctttcaaccttattttaccccgaaaagcaatacattattcaaatgaaacttcaactcagggagtttttaagaaccataaacctcaagatcatcctaattggtgctggccttcaaatctagcattcacccaaatgacactatcactgaacaaaatacttctcaaactatgagttgtacaactgtttccagatcactcaccaagcacacaagaaaaaatgaacatttttatttttatgtcaagaaaaacagcctccatggccaagcctctccagcttcttcctgcaaagcccagtgtaactgacccctgctcctccagctggaacaaacagagaaaactggagtgtgaaccagaagacagcaaaaaacagcctgcaggccagtctgcacccagcttttacatcttttctaagggttgtaaagataaaacaaagaatatgtgacaaaaattgttaagaggcacacaaagcctaaaatatctggccttttacacacaaaatttactaacctcagtctagactaatgccagttcccagagaaagccctgagaaggcaaactactactgagtatcaatttccagaagcagactgacaaaaatctaattttttctaacttttgaagtctccctttctaactgccggagctctactcaagctgaccaaagttctagagctgaattccactcccctggcctcatgcaagaggggtctcctgcaggaaggaccccttccagcctcccactgcccacaatgctcacctcaccacataactgggcagccttggagaaaggggactgagagaaccacctaggctctctgaccagctgcccacccactagggggggcccattctctgctcaccccaacagaggcagctgtgctcctccaagacatcccttgtggtagcaggtgggagagagaacttgaagtccatctgggaacacatcaaagccatatctttgaaacaggtttaacggtaagtcataaagctaatgttttaatctccactggttaaatttactggtaccctagatacaaccttctatttataagactgacaatatctcaagaacaaatcactcttcttaaccacacaagccacctacgcatgctctgtatcaaagcttgttttatttaaccatgacattttgccaatgttacttcctcaacaaccaaaatggttcacagtcatcccatgaactatttgctaagtgccttctatgggccaggcactgttctggcaataggcctctgtcctaatgccaacgaaaggagcttatctgcgggggaggctgactgataatcaataagtaaaaaataaattcaagaacagaaacgttcagagatgaagctaaaatagaaaaatgtgatggaggctgggggaagcagggagacctgctttggtttaagtgatgagggaacagctatttaagatgacattagagcagaggcctttctgaacacaaagagaacactgagcacaacgagttggagagaagaatgagctttgtcaagcagagagagtaagaaaggcagtgggaaattggtgggaaaaggcaatgtggccagagtaggcgagacctgacacacttggtatcagtttcctggtgctgctggacaaataactacaagcttaaagggattacctgacaattctaggtcagaagtctaaaatgggttggcaaggctgcattccttctggaggcactagggaagatgagctcccttgcctttcccagcttctaggggctgtccacattccttggctcatggccccttccttgcttctctccaacttctgcttcctgttgtcatttctcctgctcagagtcctcctgcctccctcttgtatgaacccttgtctttacattgggcccagtggatacatcaggaaaatctccccatcgtaagatcttcaccttcctcacatctgcgaagttcctgtttccatgtaaggttccagcattaggacgtggacaactttgggggtcatttctgcctcccacacactttatttctgaacagtgtctgaaatagcagagtgatgtgatccattaacttttttaagatcacttgggctgctgtgtggggaaagggcaagagtggaagcagattagtcagcaggttattactaatatatatttcctattccttaaaatctctacagatcctaaaatattatacaggtaggctttttaaaaaatggaattagagtcagaaatgaattagcaacaaccaatcaatcattacttacacagaaagggcacgagtactctgagtcatttttaacggcatctctgacgtgctcaaatgaaaacattaaaatttaagtgcagctgacctttgaacaacatcaggtctatttgtacacagattttcttccacctctgccacccctttgagacagcaagacaacccctcctctttctccttaacctactcaacatgaagatgacaaggataacctgtgtgatgacccacttccacttgatagtaaatgtattttctcttccttatggttttcttagtaacattttcttttctttagcttactttactgtaagaataaagcatataatacatataacatacaaaatgtttgttactcaaccctttatgttaccagtgaggcctccagtcaacagtagactattagtagttcagtttttgagaagtcaagttataggaggattttcaactgtgaggggtgggggcaggggtgcaggtggaggtgtcatctctcctaacctctcatgttgctcaagggtcaactataagaaaagaagggcctcaaatcagttatctaaacttccaccttaggaagctagaaataagagtaaattaaacccgaggcaaacagagagaagaaaataatgaagaaatcaatgaatagaaagaaaagcaaaataaaggaaaccaaaagccacttatttgaaaagataaacaaaagtgactaatgttttgctagtatttaagaaaaaagacacaatgtatcaatatcaaaaataaataatcagacatcggccaggcacagtggctcacacctataatcccaacactttgggaggctgaggcaggcggccttgaggccaggagtccgagaccagcctggccaacatggtgaaaccccatctctactaaaaatacaaaaattagccaggtgtggtggtgcatgcctgtaatcccagctactcgggaggcggaggttgcagtgagctgagattacactgctgcactccagcctgggtgacagagcaagaccctgtctcaaaataaataaataaataatcaatcagatatcattatagattcaatgtagtaaaaggataaggaataatatgaacaattttatggcaattaacttgaaaacttagataaaacacaaattaccaaaactcactcaacttaaaagacacaaattaccaaaactcactcaaaaagaaatgtaaaccaaaaataaaattctgagttcgccaactgactgatggaccctcccctccaccaagggcaatccaaagctaacctgagaaactagttcaggccatgatggaaagtgggagtgggagtaggacattcttcattatactctcctcccgttggaattcaggcacagatgaccagcattaacatcaacacaggacctgaagactgacagaacaggccctttaagtctgacaagaaacatttacaatctattttctctgaagcttcccacctgaaggcttcatttgcataataagaaccttggtctccacaactaagacactgcctttcactgattccaggtctttagataaattctttcaaccaattgccaatcagaacatcactgaatctacctataacctggaaggccccctatccctcactgcttccagttgtcccacctgtccagactgaaccaacgtacatcttacatgtattgattgatgtcttatgtctccctaaaatgtataaaaccaagctgtagactgaacaccttgggcacacattctcatgatctcctggggctggtcactcatatttggctcagaataaatctcttcgaatatgttacagaatttgacttttcaaacagaagaaactcaagtagccctgtatttattaaagatatcaaattcatagttacaaatcttcccacaaagaaacttcctagaccaaatgacttcgttggtgaattttaccaaacaattaagtaagaaataataacaactatgcaaacttgttcagggaaatagaaggaaggaacatttcccaattcattttatgagaccagcactatcctgataccagaactacagaccttacaataaaagaaggcaaaccaatttcccttatgaaaagttataaaatcctaaaaaacttaagcaaatcaaatccagcagtatataaaaaggattaatgatcgagaggtctgttccaggaatacacaattgttaataattgataatcaatcaatcattcaccatattgacaggctgaaaaataatatgagaatcttaatagatgccaaaaagagatttgacaaaattcaatacatgttcatgaaaaaaaaaaaatgcctcagcaaactacaaataaaaagaaacttttcaccctgatgaactgcatctgtgaaaaaactacagctaacatcatacttagtagtaaaagactggatgccttccccataagattgagaaaagacaaagacgaacactcacactgcttttagtcaactctataatgaaaatgtaatggatatataaaaaaaaataaaaggtgaacagataggaaaggaagaagtaaaactatctttattcacaaatgacttgactacctttgtagaaaaccccagagtatctacaaaaaagagtcctagaagtaaaaagtgcatttaacaaggttgcaggatacaaagacaatatacaaaaatcaatatactagcaatatactagtaataaaaaattgggagtaaaattaagaagaaatgccacttacagtaacatcaaaatatatgaaaaacttagaaataaatttaaccaaacatgtctaagacctgaacatggtaacagacagtgcggtattggcattaaaaatacccagagaaggccaggcgtggtggctcacgcctgtaatcccagcactttgggaggccgaggcaggtggatcacgagatcaggagatcgagaccatcctggctaatacggtgaaaccccgtctctactaaaaatacaaaaaattagccgggcgtggtggcgagcccctgtagtcccagctactcgggaggctgaggcaggagaatggtgtgaacccaagaggtggagcttgcagtgagccaagatcacgccactgcactccagcctgggtgacagagtgagactccatcgcaaaaaaaaaaaaaaaaaagtacccagagaaccctgacataactcacacatatactgtcaactgatattttagacaggtcccaaaataatgtaatgggggaaaagttggtctgacaaatggtgctgggagaattgaaaatgcaacaaaacaaaaaccccaaaaaaagccacctgtgtataaaaaaaatacttcgtcgtttttattccaggttcctggcccaaagctcctaaaaccctcagaatttcctgagtgacagagtgtcttttgttattcctaacatgcccttctcaaccaaacctgagtttatgctaatgaactgactcttagagggcccctagatagctccaggacaggcgctggtcaccagaaatatcaagccatgatcagagggttagaactttcagtgccctacccacaccttcagggagtgagaggagctggagattgagctcagtcgccaatggctaatgatgtaatcaatcattatgtaaagaggcctccataaaaaatccctgaaacagggcttagggagctcccaggttagtgaacacatggatgtgctgggtaagtggcacacctggagagggtatggaagctctgcaaccctccaccctaactttgctctaagtacctcctccacttgactgttcctcagttttctcttttataataaactggtaatagtaaataaagcactttcctgagtttcgtgagatgctctagcaaatcccattcctgagaccaattatgacgtctttttttctaacaccacttctgacaccaaatgtctgagggtttccacaccaattcttcaacatcaagcgggtatccaacaattcagttaaattctgccaccatccaaaattagtgggatcccacaagttaaggggtcccacaaggctgccctcacttcagatgcaactcacaagtcccaggggcaacccatatgtctgaaacaaccagctatagatttggggattcccctaaactcctcaggttacttaattcactagaatgactcagaatttaaaaaaaaaaaaaaaacactttatttactatatgcaactcaggaacagaccaatggaacagatgcatagggcaaggtatgggaagagggagtacagagcttccatgccctctttaggagtgccaacctcctagaaaatcaatgtgttcaccaacctagaagctccctgagccccattttttgttttgtttttttgagacagggtctcactttgtcacccacgctggagcacagtggcacaatcacagctcactgcagcctcaatatctcaggctcaagcaatccttgcacctcagccccctcaagtagctgggattacaggaatgtgccaccacacccagttaagagggttttttgtttgtttgtttgtttgtttgtttgttttggtagagatggggttttgccatgttacccaggctggtctcaaactcaagccatccacctgcctcagcctcccaaagtggcagaattacaggcatgagccaccgtgcctggctctgaaccccgctgtttaagggtctttatggaggtttcattacctccatagggagacatgaatgactaaatcactggccactggtaactgagctgaatctctggcccctttcccctctggggggagagggtgctaaaagttctaatcctctaacccatggctgctttttctgacaagctgcccccccatcctgaagctatctagggtcatctcattacacaacaaaaagcacttggaccattcaggaaactcccagggttttaagagctctgtaccaagaacaagggcaaagaccaaatatattttttattctctttcacaacatatataaaaattaactcagaatacttcagagtcctaaatataagatataaaaactacaaaagtattagaaaacaggagaaaatctttctgactgtggggtaaaacaaaatttctaaaattcacaaaaaggtacaaaccataaaaggaaaaaaaaatgataaatcagtcttcatacatgtatacatacgtaacaaacctgcacattgtgcacacgtaccctagaacttaaagtataataaaaaaaagaaacaatatgtaaatttttaaaaaatcagtcttcacataaaaaacttttgttcttcaaaacaaattataaggcagaaaaatgacaggccatttagtggaagaaaacttaccaagtataacagataaaagtcttgtatcaagaatataaaaaaaaacaaaaaaaaaaccttacaactcaatgagatgagattctaagaaaaacattgggaaaaaattcaaataaacaagtcatcaaaacagatatacaggtgacacatatgaaatgtaaactaaaactacaatgaaatatgactttgtatccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggataaaaccagtaattctacttctgactatttacctgagagaaataaaattatgcattgccaaaaaggtgtgtgtgaatggtcacagaagtgatgcataaaagccaaacgatggaaaaacccaaatgaccatcacctaatgaataaacaaaccgtgaaacagtcatacaataaatactattctcagcaataaaataaaatacatgccaataaaatgaaactagtgaaacatgaatatggatgaagctcaaaccattatgttaaatgaaagaggtcagacacaaaagactacccatagtatgagtcaatttattttaaaattacagaagatgctaaactaggagcagcaaggagattagtactttcagagatcagggcaagggaaggggcttgactgcaaatggacacaagaaaactttttaagtaacgaatatgttctgtatcatgattctgatcatggtttaaatacctgtcaaaattcatcaattatacattttaaattggtaaactttattccaagtaattcatacctaaataaaacattttttattccaacaaacaatatatgacaacaacaaaaaaacaaaaccctatatagctaaactaatacaaacttgttaaactactacaaatttgtggtatctatcccttcacgttacttatcaaactctctgaaggactaacagttaaatacataaatatgacaatctaagattctgaaacaacaacggccaggttacttcatagtccaacgtgcccacacatctatccagatcatgacatttttatccatatgaacagcacacaacattcaataatgcatgttgacaattttagtgacaagtcactctttagtcataacataatttactagaattcaaaagcagaagcaaaactacctttacttttttataaaacccacactggtgtaattcagtgaaacaatttagggttctacatatagcaatcaattaccaagaattgtttatcatatatcttaggaaatttcaaaagaaaaaatcctcattctcagtaatttctcacaaaatttcatttcaaaaatgttctggtaaaaacaatgcatgtgcactttgttactttgaattagaaaagtaaaagaacaaaaataaacagatgacggtgatttcacatttacatccaacgcagcagcccaatcagacttctttagaattttgtgattggcaaatattaaaattttaactacataaacattttgaaatagcagaattgttttgacttgtgtgtgtgtgtatgtgtgtgtgggtgtgtgtatgtaaggcagagagacagacacacacacacacacacacacacagagagaagagagagggagagggagagagagagaaggtaaactaaaagtgattaaacagtttttagaatatgtaaggaggcagcacacattcagtccaatctcacataatccatgtagccaatgcttcacaagaagctttgactaacaaaattatttttcttagtattctaagagaagtacaggcaagccatgaacccagaagtggtgttctaatctacaagaaagaatacacaacagtgattcccaacctgaagggtatgactgtgatcacacatttacatccaatgtagccggccaaccagaaagacttttccagaatgtcacgatcaacaatatattaaaatttggggtatagcacaccatgtgaaaacacattatgtatgggaaacactgtctgtatctgtgacaactatgacatatttttatctgtatttacatattactgtggttaatagaaacatccattttaatacattactgtaacaatgacattttgacattacacaccttctcaatgtagggccactaaaatgtctaagtgtataaaattttaagaactttaaagagacacctcatattccttctaggttctagattagaaaccacagtctaagagaaaactctgtcctaactgtcaagagaagtagtttcagctaagccaccacctttaaccaggtctttcacttcacagggattctataaaattaaagggtctgaattattctataggaactcttttagtctaaaatttatcttctcaaatgttgtaatgggtcgggcacagtggctcgcgcctgtaatcccagcactttgggaggccgaggcaggtggatcacttgaggtcaggagttcaaaaccagcctggccaacatggtgaaaccccgtctctactcaaaatacaaaaattagctgggcattgcagcaggtgcctgtaatcccagctactcgggaggctgaggcaggagaatcacctgaacctgaaagtcagaggttgcagtaagcagagatcataccactgcactccaacctgggtgacagaacatgatttcatctcaaaaaaaaaaaacaaaaagaaagttgtaacaacaatttaggaactcagttaatatcccaattttagtttccaaaaaaagaaaaatacactaatatactttgtatttttcaaaattatttactttgcatatatttgcttaatataatttgttaatataacgaagttatttcagaaagtttgaagacagaaaaaatatcacctttaatccatgatcttttttttttcattttttcaaacagggtctcgctctgtcacccaggctgaaatgcagtggcacaatcacggctcgcagctttgatcttccaagctcatgcgactctcccacctaagcctcctgagtagctaggactacaggcacgcaccaccatgcctggctaattttagtatatttttggagagacagggttttgccatgttgcccaggctggtcttgaactcctaggctcaagccaactgcctacctcggcctcccaaagtgctgggactacaggtgtgagccacctggcccatgaacttattggcacagacatagtttacacagctacagtaataatggccataacattttatatacaactctctctatgcttgtaacaggttattttccacactccatgtatatcactttataagtatcgtatttatatgtctttatatgtatgactttaaatatctacttaacattctaatgagcgcatcggtatataataagtcacttaaagagaacatcctggtagagtccttagaaaatttcatccttgtataaacatcattgagtatatatacacaaacctagatggtataggccaggggtccccaacccgagttgatgaatggtactggtctgtggcctgttaggaaccggtgacacagcaggaggtgagcacaggcaagggagcattactgcttgagctctgcctcctgtcagatcagcagccgcattagattctcataggagcacaaaccctaccgtgaactacgcatgcgagggatctaggttgcacgctccttatgagaatcaggccaaggtggcctgatgatctgagatggaacagtttcaccctgaaaccatcccctacataaataggatatatggtataacatatttctcttaggctacaaacctgtacagtgactgtattgaatgctgtaggtaactgtaacacaatgctaagtatttatatgtacctaaacagaaaacgtacagtaaaaatacagtattataatcttatgaggctgggcacagtggctcacccatgtaatctcagcactttgggaggcctaggcaggtggatcacctgaggtcaggagttcaagaccagcctgggcaacatggtaaaaaccccatctctactaaaattacaaaatttagctgggcatggtggcacacacctgtatcccagctactcaggagactgaggcacgagaatcgcttgaacactggaggcggaagttgcagtgagacaagatcacaccattgcactcctgcatgggtgacagggagaccccgtctcaaaaaaataaaaacaaataatcttatgggaccagcattgtataatgcaggctactgttaaccaaaatgttgttatggagcacatgactgtatttgtgtatatatatacatatatataaaataaagtaaaatactaggacaaaaataataattatttatattaggggatgaataaagtagaggaagtagggttagagagagttctctctgtatacattttcatacattttgacctaccatgctacttttttaaactaaaaattgattaaaaaacttaaaatgtaagtgaagtacttaataatgctaaataatagatttctgagaagtcagaaatcacttggcccaacctccaatgcaatgtaggaatctctttaatgtttatctgttttcctagcattttagaaaaaagatgtagccaaatttactatcagtaaataggagagtggtatgagacaattcagagaagctgcttattatatcccaaccattcctgaaaaaaatcagtgaattaaagcacagtttaaaggctgattaattccagcaaataaatgctgagtccctgttgtttgctgtgttctgagaatgtaaaagatgattctcaaagaataagaggagttcctatgctcaagaaatttgaggcaagaccatttgctaagctttaaatatttagaaatgagcaaggtatcactggaatacagtattaatatatacagagaaacctttgtgggagaagaaaaagaagagggaaaatgatgactttcaagggatggagaagaggctaaaaggataatcaataaacggtacactgtgtttttgaggtttcttttttttttgagccggagtctcacactgtcacccgggctggaatgaggtggcgtcatctcggctcactgcaacctctgcctcccaggttcaagcaattatcctgcctcggcctcctgagtagctgggattacaggcacctactaccacgcccagaaaattttttgtatttttagtagagacagggtttcactatgttggccaggctggtctcgaattcttgaccttgtgatccacccacctcgacttccaaagtgctggaattacaggcatgagccaccgcgcccagcagaggtttcttttaatattactactttggagtacaaattaaagctttaattatgtgaaagaccacattcctcaacaataactgataaatgtggcctgattaagatgtttatactaatataggctgtaagtttaaatattctttaaataatgtaaagagattttatttacctataattttatttcatatgtacatgttaaaagacagacctctttgggaggccgaggtgagcggatcacgaggtcaggagatcgagaccatcctggctaatacagtgaaaccctgtctctactaaaaatataaaaattagccgggcttggtggcgggcgcctgtagttccagctactcgggaggctgaggcaggagaatggggtgaacccaggagccgagatcgtgccactgcactccagcctgggtgacagagcaagactccgtctcaaaaaaaaaaaaaaaaaaaaaaaaaagacagacctactggtcagcttataaatgtaaatacatgtaaaaaagaggccatgtgtggcctgtaattccagccctttgggatgccgaggcaggtggatcacctgaggtcaggaattcaagaccagcctggccaacatgttgaaaccccgtctctagcaaaaatacaaaaatttagccaggcgtggtggcgggcatctgtaatcccagctacacgggagggtgaggcaggagaatcacttgaacccaggaggcagaggctgcagtgagccaagatcgtggcactgcactccagcctgggcaacaagcgtgaaagtccgtctcaaaaaaaaaaacaagaaaggaaaacctttcggagaaatctgaaagaacagttccatcatatacactgaattactaaaagagaatgatatgccccaatttttctataattaagacactgacttttgttgacaaaatacagtcacaaatcttgagttaaaagattatcctgattgtacgaaagtttaaaagcacataaagcaaagtaaatagattaaattaacttgttaaaaagtactcaaggctaacatgttattctaataaacagcatgtggtatattatttgaggacattttgcatgtcctcaaaaaggcaatctgtaacagacatccacaaactgtgctaaagcattaaagcttttttcaaagtatattcctaatgcagaaatctagaacaaatgggctgcaaaagaatatgtaaaataaaaagaattccaccagtaactatagtgcaataattataaaacctactgccaacagaaaaacaatgccgggatgaccactaacacttatttttaaaatgttaatctgtcttcacaacattgatatcactcctcaaaaattcatataattgggccttctttaaaaaccctaaagctactctgtatcttcccaataagccatccaatgacctttagagaacctctcaaccatcagtcatgtgttatactcctttacctcaagatcatattcacctggtgaatatgatctagacataagaatcctaattctcttgatataagtctttcacattgtttaaaaaaacaaagaactcaaaatatacataaaacccttataagcactcctactaagcagacagtattactcacatttgacaaatgtgaaaacagaaatctgtactgcataacaccataaccctagcagctgggagtaataaacctacactctttggttactcaactggaattaaaactaattcttttcggtatcctacattttaagaaatgtattaaggaggcaataaaaccttatcaaaagccaaaatacactgcatatttctaaatatcacactattctgcaatattttaaggcagaagccacagagattgaagctttaaaaaattgagaatccttaagaatgaaactaggggccaggcacagtggctcacccctgtaatcccagcactttggaaggccaaagatggtgggtcacttgaggtcagcagttcgagaccagcctggccaacatggtgaaatcctgtctctactcaaaatacaaaaattagctaggcgaggtggcaggcgcctgtaatcccagctactcggggggctgaggcgggagaatcacttgaactggggagacgagggttgcagtaagcgaagatcacgccactgcagcctgggtgacagagcaagactctatctcaaaaaaaaaaaaagaatgaaactaaagaatattggccacaattaagacacaacaaacaacattgtactacatgtactacaggtactacaaacaagtattttaatggctcaaagattttttttcaacttccaaaacaatctaaatgttgcaaaagcttctttctaatgctgacagactaagcatgtttttttcttgtgaatcagtaaaacacagacaaagaggagttgttggtaatggggttcaaaccaaagaacattctaatggaaaacagattactattgaggaaaaatcagactacagtttaatttcataatacaacatatttacataccagcacagaatatccctgggacttcactcctgattattatggtccgtactttcttatcagatttcaaagcatccacagcttttgatagctaaacagaaataggaagcataggaggaaaaagagaaaaaaaaaacaaaacatttttacattgatgacaataatatatcttaatattagaagcaaacagtttaatctttacactcaccatttttataagatttttactgagtgaatttttgccataagctctgtttattccaagcaccacaattcctagttaaaggggaaaaaaagtacaagcacttgagtgagcaaggcattcagagaacagactctacatcacacatctagctagcttcgaacttaacaaatcaaagaaattcatgacatcacgttcccttcaatcgatctcttcttaagcaccaagataatttgcaacattttggtaaattttacatcactaactcaaactagagggaagactagacttattagtgaaaattttaagttaaaggatactatttaaaatgtggtttcatcatcttcaagtagataccaaagtaaccgctaataaaccttgtcacatgcaggtattatagcatctgctttttctaggaccagttgttaatatctccatttttttgttgttcatactacacagttttcagtaattctatcccaagcttctctcctgatttctgtctgatatacttaacctgagggcacttccatttagatgtccaagaagtacttccaactcaacctatacaaaacaaagttcattatctctcccacaaacccagctgtcactcctaactgccccactttttaatcaaagaccatcacctaaacccagcctcccattccttccagttaccaattttctaaaaacagtactatgcatagaatgcatcccctacttaaaatcctttcattatttatttcaaaatatccaacttcaaagatcctaatttgatattcaaagttctacacaacctctactaaccttcttgttcttggagtagacaaattttcacagtgtatcagaaataccttccactgagtcagggtgggtatgtttcttatttgcaactgagctaaactgaagacaacaaaatgtacacatgccttcgctgtgcaagaaactgtgcagacccattctttaaagtataaagatgaacttctgctcacaagagtaaatttgcaagaattccaaatgctctcagtacagagaaaagcataaaggactgctatctgacaggatctgtattaaacagctgaatgactttgggtaggtcccaatactactgacaacagctaccaccagtaggcctcaggcactgctccaggtgctttaagcgaattaactcatgtaatccccaccacaacccaagaggtgggcactacttttatcaatagttaacggataaagaaatggagacttggagaggtgaagtaacttccttcagctattaagtggtaatctaactctatacttgaataaaactgtgttacactgttcaagcttcagtttcctcaggaagaaaatcaagcagctaagactagatgtgtccattcattcaaacatactgagtacgtactatagtgatcagcagccatggaactagagtctaggagggaaatacaaacattaataatcatagaaatcattaataatcataaatatcattaataatccattcaaactgctttacaagctgtaagtggtgctacagtaacttgtaaccagaattgataatggtctggggcaaaaggagatggttagggaaagcttaccccagacagtgaaggttagaaggataagtaggagtcaaggtgagagtgaaggagaggggctgactgccaggcagaggaaacaggaaaagcataaactagtcatggtcccactgaatgtcctgtaacctacgagggggagaagagagtgaccaatgaaagtaaagaggtcagcacaagccagaaatatccttacagaccttctaaaaagtctggtcttcatcctaataaccattgaaggagtttacgtaggtataaacatatacacatgcacatataaaactggcgggggaatagtttctatacttggagatcataccagaagtagacaggggtgggagcttcaagacacaattcgagtccaatcaacagataacaggtttggctgagattggtggtggtaaaaataaaggaaagtgaaaggattcaagaactattcaaaaattttaaatgagttaatgatgcctagactgaggactgatttaactggaagaaagtgttaaggagtatttaccaggtttctggcttcaccaattggatgaaagatgacatttaatgagacaaaatcataaaactaccaaggtgagggtggaggggagtaaagctcatgagtttctgtttttaattaaagtgaatctgaagtgcctttcagacatccaagttgatacaacgtccaagggctaagaatgcaggctctaaggtgtgattgctggggatgaaatcccagtctgccgcttactagctattcggcaagttacttaacctctgtgatcctcagtttcttactctattaagaattcggcaagttacttaacctctctgatcctcagtttcttactctattaagatactaacagttccacactccatgggactgtattagaatcgaatgatatgatacatgtaaaatttacaacatgaggacccaattaacctcccttctagcatgaacacctctcatgcagtaagtattaaaagtttcaccataatttctgctagatatgataatgctgacattattactgaagggtaaagtgccatcaaaatgtttctaacacagttaattccagcaattttggtcccatatctgagacttgatgttttgagtacttccacttcaaaaagctagaaattagctctgcaatctgaaatgaattatctaatatgtaacaactgtaccatcaaatgtatctgtaggcttttggtattctaaaatggaataaaaccttagctttattcagcaaagtctaaaagtttttttttataactgtctcactttaattcacaattcaatcacttctcaagaactcaattatcatgcatcctcctcacataacctagaaagtttaccaaactcagaaaagcttaggcgttcacatgccaaccttaattttcctgacttttcacaaaacatacaaaaatcttcagtgaatctgtaacaaggtcacatcacagcatgaatcctgctctataaagctcacacaactgaaagatgaatgtaacaactttgctgagactttaaaaacaaaacaaaatacgttctgcttatacaaaatgaaaaaatacactcaaagtgaaagtcctccttccctagaaccagctcattcccttccccagaagaagccacagttatcacagttacatgtaatgtaaccttccagaaaatgttcaacgtatctacatacagaaatagagttgtatattaccatttggcttgttgttgctattttacataaatggatcatatgttctgttggagctattctacataaataggttcatacattttttctttttttttaagagacaaggtcttgttgtgtcacccagactggagtgcagtggctccatcatagctcactgcagcctcaaagtcctgggcagtctccatctcaaaagaaaaaaaaagaaaagaaaaggaaatttggttatagagctatgcctcctacaacaaattacaaatatggagcccagataacagatgagacctggtgtattctgcactacttacccccacccacctaaagtgctgcatgctgtttgaggctcctgtgactaggagagttatcctattccttagaggctgctgagagcaccaaattttggacccacctctaagagaaataaaggcacccaggaaactccttcacctgtagtacccttgacctcatgtttttctttgcactgcttattgctggttcaacagtaaagcaaagcaaagcctaggtaatgttagccaagcctgagtcgtcattcttgccaattctcaaaggaggcggggtcaactttaagaaaccatgatgtatgtcctatctcatcaggaaatcaaggctaaagaaaaaaaaaaaaagaaaccatgatacccaaaaaaattttcgtttattatcttttattatctgatattctctcttctgtccattcagatcctaacttaaagtctgtccagacattctgcacaaatattcctttaattgcattcaagtcataacgaccaaaaaaatagaatatggtgcatattagtagctgtacttgcaatccctttatatctaacatattgttggtacacttaacggaagtgaagtcccggcatgactaagcttacccaaaagatgatggcattcaggctctaatcactccagtgctagtctatgcttccagctgaatttcttactattctgcttatgccacacttgccttatgttacgtcccaaatacaccacacatgttcacatctccatgcctttgaccatgttcttgtctctgtctggaataataagtaaggaataaagtcattcatcacactcctgaagcactgctacgtgctagtggcaatttacattaacaatctcatctcatcttcataacaaacctataaagttggtattgtttttcctgttttacacgtgagataagtctgcccaagaaccctcacaaatggcaaaatccactgcctattaaagaatgccttggaacccctttcaaatggcgaaaccctgcaggtattacagccctttcctcttaccatgccttgaaagttcacacagcctactaataaccaggatctgcttcactacactaaaaccaatcacgacttacacgcttttcacttctgcttaacagattataggtgctcaacaaatgcatgtcaaaattaaaacactggtcctctggcttaacccggaggttaagggtggaaactgctattccacccttcacgacccttttagcttttccctgcactgccagtgaaaggaactgagctgtaacagtattccctaggattgtcagcctccttcaaagccttcaaagctctgtattgtattgctaatgatgtctcctcccgtagaaggtagctcaagggcaagatccataccatccacattcttatcgccagagctgaggaaaataaaaagtgctcaaaattgtttaaatgaagtggaacagtccctcaagactaactttctaagagaaaatgaacaagaggaaaaattgttccagctgagcagcttcaaatttaagattctccgtaataataaaaggcagtttcaccgcagcttttacaactccaccactaatagctgagtttacagaaagccattacacagcaacaataaagcctggtagcaaggattaaatccccagggtatatattgaccttggcttgtctggagcggagggcgtaagctgcacttctgtttgccgcgctgaatgcggtcactttacaggtaagctgctcgggggtacacgtttaggttattaaaagcaagaaataggtgcacaaggaagcggccacgctgggtgagtagggaggtgagaaaggggagggacccaggttcggtgcgcctgcctgacctcgaccccgcgtcctgccggcggacgctgcaccttatgcccgtcctgagagcgagcggccgcccgctgccccgcgcctgcccagcgttcgcacctcacctcggttctcctcctccaggtgccgcacccgcagctcgtcctccgtcttcatctcagagctgtagccccttttcggggcgggacccccggccgcaggtacccagccctgggcccagatcgccgggcccgctcgccggcctgccaacgagccgggcagcctcaaccccgggcagagccacgcactgcaagcggccaccaggcgggcgccgccagcatgcagggatcccaaggccccaggtgccgccgccaccgcggccgccatgttgtctgtttacggcgtggacctgcgacggccgc

SEQ ID NO: 263 - DNA, 218 bp, Homo sapiens
ttccttcacctataaaatgagaataattatgcccatttattgggttgataagtatgtaaaacacttggcaccaagaaagaaatagagcagcgtggaaatattagctaccatttaccaacttccttcttagtctatttaagaaggcatttcgctgtcttatttaatgttcaggaaactttcaagttggtattactacccccatttttatagatgaggaa

SEQ ID NO: 264 - DNA, 14818 bp, Homo sapiens
ttctgtgtttgtcaccaatcctttattgaaactggtaacttacacactttataatagaacaacaaaaataatgttcaatatatacagccttcgcatggactatctgactatacacaggcagagtgataacacaatctaatcttcatcataatctgtgcacaaaaagacaccaaacagacaacatgtgcacatcacagtgaaatgacatcacaggtccagtgaaaattcagcataatacaaaatggactgctctattgcaaatgacatctttctaaatgcccagctcttactcagtagtaatttacccagagtctgaagcagagattggttgtgtggctataagtctcttgagtgagacaacctctgcagataagtttgctatcccctgcttcaaatacaagttctctgggtcagaaactttgtagccactgtctttcatttcaacaactccagttttgaaactattctgagttttgccactcagttctttttgatgccagtgctccgatttgagagaccaatcttgaatgttagtcacttgcactgagaaaggagtaagagaagaatgtaccatacttggggcactatgcttttcgagttcgaaatgtcttttagatgtcatgtcaataggtgaggaaagtttttgcgtggcctcaaattcattatcaaaggcttctactttgatctgcatggctttggctttgatccggagcttgtgtggcaaggcagaggaattcacttctggaactttaaccacagttgcatgcacatgcttgagttcaactggagaatggatggggcccttggggacctgttgctcgtcttctccatcagatgactttcctaccacaccatcatcagtttccgacgttctcggggagttgctggaggatcggttgacttgcagtagtgggggagagtgtgagtacccagagaaagaattccccatatagttttgatagatggacgctgtgtaagagcctcggtcatctcttggctcccttgtgtagctctctaattccatcggctcttgcttgataatctggaacttgttttcaggacttctgcagcttccctgcacagagctctcctgcgtgtgttctactgaggacacttctgaaacatcggacagcgagctttgtggagagtgtttaatgacagaaatacaactacttgacaccatcgagggttcgtgctcgtccacaaatgaactcacattggatttggaagtctggtaatcttgaaagtacacagctgtagaattactgagtttctgaatctcttgagcatatgctgtggagctaattaaaccaaactttaattttagtgaaagcagctcagcttttaaagtggcgttttcttctcccagtgcaattagtttgttctctaaaaccaggtcattcagtcgacgcttctcacgagatcttttggcagcttcattatttttccgccttttttcccaatacatagcatctttcttttcatcaggaatgaattcccgtttcctccgacatgcagaagatttgttcttccccacacttccttcactgagaagcagctcctcacctgttgtggagtcttctgacacttccgttaaagcagaattaaggaccatcatcttgtccacattgctactggcatcaagagacgcctgctcctttttgacggtctgcatttttctcagctgcatcagaaacaaccttaccctatctatgtgtgtaggagaacaaattaatttccccgtattctcaagctctttaaaaactctggtttaaaatccatcaatattcttccttttgttctaccgtctgggataaatccgtcaggctccttattgaatgaagttgggcctccttcgttatctgcaatacatgaataaaaaaaaaaccagttattcactggataaatgtttattacaaattatgtacaaggaaatatgctaagcatttagggcatacaagcacagatgaggcatggccacagttctttctttcaacaagttagcattttcaaaaaggaaataagttcccaaatacctaaactataaagctgtaaaggacaaatccctaatgaggcctatcagtaagagaatatgtgatccaggaaagtgagggaaaaataaaataacctctgcccagagagaagtagaggaaggctgtatttaatgaggcgaaatggagaaatagttgggtgtgggcaattacaggaaggaaatgacagatagcctctggttggtaagtttctaaacagtacatgcataccgtggtgcttctaaataatgttacctaatatttacatcactgccaagcagatatgctcacctcttaaaagggactttaccaagtaaactttaacgtgagtaaaaaaaaagttctgcactcctatatggaataaaatacaaatggagacaaacttcttctacaaaaactaaagtaaaagccacattaacaacggagctgttggttttaatctacaccttaacgtggacataaacctgcccatcacatccttgactgcctggtaggcttatatcccagcaaattccaccaggtgactcactgcaactaaatgaaaaggattcttctccatcaagccatctctttacaagcatctgagtttaagagattagaatttttttttctgattcctttgaatttgttctatcaaacattcaagattgaagtatccaaaatgctttttgtgatcttgaaaattctgtcaaaatagatttcaggtttcagttacatagtagctttgaactaaaaaacagttactaggcggggcacggtggctcacacttgtaatcccagcactttggtaggccgaagcgggcagatcacaaggtcaggagatcgagaccatcctggccaacatggtgaaaccccatctctactaaaaaatacaaaaattagctgggtgtggtggtgtgtgcctgtaatcccagctactcgggaggctgaggcaggagaattgcttgaacctgggaggcagagattgcagtgagctgagatcacgccactgcactccagcctggtgacagagcaagactctgtcaaaaaaaaaaaaaaaaaaaaaaaaaccccacacaaaacaaaaaaacacttactattcaaagggggtttttaaaagtatagtgcattcttgaaatgaaattcttttaaaccaagagaatatagttacagaaaaaaatttctttcatttatatgaattagtttcaagtaaaatataacaactcaaaaatagaatcattcattagtttcctcttccattgatgaaatacttacactacaaatttggcctgacagttgccttagctcgagataataaaatccatgttatgttccagtagcaatcattgcatgggggcttttgaatttaactgtgtttctagacactgattctctgcctaatgttccagtcagtaatatttttcgttaaatagacatggtacaacagttccatcagcacgatctgcacacagtggcactttattctaccctactaaaaagatgtaatgagccaggtgtggtggctcatgcctgtaatcccagcactttgggaggccgaggtgggcggatcacctgaggtcaggagttcgagaccagcctggctaacatggtgaaaccccgtctctactaaaaatacaaaaattagtcgggtgtggtgacaggcgcctgtaatcccagctactcgggaggctgaggcaggagaatcgcttgaacccaggaacccaggaggcggaggttgcagtgagccaagatcgcgccattgcactccagcctgggggacaagagcgagacttcgtctcaaaaaaaaaaaaaaaaaaagatgtaatgttcttacatgatgccactatctccttcttacgcctagtttcataatgactaataaaatgaagtttacttttatcaattggaaaagcctgccagcttcttttgtcttttccagggaatgaaaggaattatgtaataatttcaggatcataaagaataatgtttcatgccaggtttttgcccattaaactgagccaacatagttaagggaacagctagtcgtaactcagagaaatttgtgattattaatatcaagtttctgtttgttttttggtaatgaaactttaataggaaatgaaggcaaggagtgtgtcacagtcagcagtgatgttgcagagaaggaatcttcctatttatcatttaaacaatattatttccttttttttttttgataagagtctcgctctgctgcccaggctagagtgcagtggtgcaatcttggtgcactgcagcctctgcttcccaggctcaagcgactctcctgcctcagcctcctgagtagctggggttacagttacgcgccaccacgcccagctaatttttttgtatttttagtagagacgggattttaccatgttggtcaggctggtcttgaactcctgatctcaggtgatttgcctgcctcggactcccaaagtgctgggattacaggcatgagccaccacgcccggccaacaatactatttcctctaatttgcatttaggttttgtcctctaatatgaaaacccagtttcctttacatattgaatggattctttcctctgttgaagtctgcactctgccattcagcaaagtcctcctgctaaagtaaaatgagtggagaagtaaagaggaagatatcccagttaaagaagacaattgcactgacctttcccaaggcacctttcaaatctccactatactcttggccactacttttttccacttttagtttttaaacatcatatgatcccttgcagactattattctggttattttctccacctgagaatctttctcttccatgtgttatcttatttgttccttcttaaaaaaaaaaatcagattcctttattttgcctcacttactagatttacagtaatgcttttgaaatgccccgccattctgtctgccttagttactcttcctaaacttctaggaccttttcaaggttggggcccaattgggaaggagccttcacaataggtcctatttctatttaactgaaatagccccatttgtcttaaaatttccttaactcatgtcttctaggtgtctaagtactatatgactactttatcatctctacaactttgttggtacattaacctacagaaaacttcatttgcttttttgtttttgagacagagtttcactcttgttgcccaggctggagtgcaatggtacgatcttggctcaccgcaacctctgcctacagggtccaagcaattctcctgcctcagcctcccaagtagctgggattacaggcatgtgccactaagcccagctacttttgtatttttagtagagatggggtttctccatgttagtagagatggggtttagtagagatggggaaactccatggggtttctccatggggagttcaggctggtcttgaactcccgacctcaggtgatctgcctaccttggcctcccaaagtgctgggattacaggcgtgagccacctcgccaggccacctcatttgtttttaatcatcttcttcctatttgaatttcatggcatgtcactataaatctgtgattctgctctcatctgtatgtattacattcatggtctctacaactcaatggcaaatcaccacactatcttaggatattttctgtaatattatctatcaaataatcttgcagtgttgaaaagagtttatcagcattatgggatgatacggagacaggcacaatcatatacactgtgtgtgtttccacgtgtttgtcttttgtgcccaactacactgcgaattacttcagggcggaaattaaaatatacttgtcttctagcaaaaacctgaagatattaggtgctcaacatttcattgacagtcacccatataccttatataagagagttttgtaaacagaaaacttttttgatgctttctttttaatgttatgtgaattgtaaagaagatattttacttattaacagagagattctcttattcattaatttgtttattcaacacatatggagcacctactgtgtactgggcacaaggggagactaggggcacataaagagggagagaaaaaccaaactcccgagaccaggcgctcagtcgtgggtgggtgggagacaaacaggtgagcagaggggaaccaggtgtgagtgcagagttgcacaaacatgggcctggggtgcaggctttcttcttgtcatggagataataacaaaaacaatcataattggtgccatttattgaacacttaccacagaatgggcactgggagcctgacctgctttctttcattcacttttggtgacaattttcagataagaaaactaaggctcagagaagtcaagtgacttgcccagtgtcacatagctaaatggcagagcgtacattcaggcccagttcctttactctctcctacactttcacaggtggttctgcatctttgcaatgcagtctcatttacacacagttctcttttgtgtcactttcatttctgagtaatacatacccttttactaagttactttgggcgcagtaaggcactatgctaacttaactacttcttctttttttttttttttctttttgagaaggagttttgctcttgttgcccaggctggagtgcaatggcgcgatcttggctcaccacaacttccacctcctgggttcaagcgattctcctgcctcagcctcccaagtagctgggattacaggcatgcgccaccatgcccaactaattttgtatttttagtagagacggggtttctccatgttggtcaggctggtcttgaactcccgatctcaggtgatccgcctgccacagcctcccaaagtgctgggattacaggcgtgagccgtcacgcctggctccttaacttctcttagatgctgtcttaacttctttagccagcaaagatactatctagaacttttctccatcctccttagatgtttcagatctggcactatttatgaattgagaaaacattttattaattttcatatctttactaaaattttaacctcctggctattctaattatgttaaatagagaaaaagaaatatgatagctgtggacattgtcacctatgatcttcttcttttttttttttttttaacaaatccaagagtgtaatctgttttcaacatgaggcgggggacagtgtctctctgaccctctcattttgcagattaatcagctagaagacaggctgaccttcccaagaccacacagcagttgggcacagatgggctctgagctctccttatgcccctcaacaatgaacttaaagcaaatgcaaaagtagtttacgatgccttcaaaaagcctcaggatttatgctaacctaacaaatttatttcaagcctcaatattttcccttatgattaatttaacaattacttcatctatgcatcatcttttcaaatcaacatctaatgttgtggtatattagtcattgcttaagtttcttttttggtgaataattgacactacatgccaattctatgatgttagtgtattcagcacgattaacttcattacacacattagatgatatgactctccttgaaaacacaaataaaaaagagaaatttaagagcaggtattattacctaccagttgacatatttttccatacatactccgaaggtgccatcactaattaatgcttttgtatagtccatcacactacttctctaagcaagaattatatagcaagaattatatttcataagcccagatttttaaagtttaagtcagattaccctattgtttttaattaagtacaagatttgatttagaaaattctataaaagaatataacctcataacaataattctagaccaaatttatccttgaggagttatctcattagttatgtttatgatagacctttatcttccctggtctctcccagaactaatgtttaacaatccaagctccacaaaagaaaagaataaacatgctttgtttcaatcatctgaaatcttactaatagtctaaacattaaaatctactctgagaacattttgttattaattatctataaagggtaagttttattgcaaattgcaatatatattttgtttttaaaattctgtcaatagaagatgaaatactatttgatatgcccaatgatttggaaacattatagaattatcttattttccctctactctctgaatgtattgttttctccctgttatataatacagataacagtaaaggaaaaaaaaatgtcttcaaggtaaacctaagttatgttaaactgtaagccacctctccagtaagacagcagatgcttattttttagataaatgtcattttcatgaaaaaatcaaatcaattaatcaattcacatctctttatacttttaaagtatgaatactagcaatatgttaaccctacattttcttcctgtgggtaaaattcacagtatctgcgtcaatgaaatgctttacttcttttcatggatgagaaaacaatctagtatttaaaagcagagatgaaataagaaaagaattcactatacatgtacaacccagaggaaatggggagtgaaaaaactcagtcagaaaacaccgaagttgcaagagaattttctaatcccgttgaaaaagagaaggatttttaagctgagaaaactatgttaaacctctctaagggccattctgtccccaagaagcagcttaccccaaagttagagagaaatgtgcacttgatcaagacaggcaagacgcacacacacacatacacacacactctcgcacactgccagaatctattctatcatagcaacaaattgacctactttttctatttgggtgcctctgtaaataaatgtgtcaaagcctgatccagtttatgataaatgaaaatatttcaagttcgacaaaggactagctgaaaattaaatttaaatttaataaatacgatgacaacattgcattttattacatcactgatgtaatttaagtaattgaaatatgaaatagtataacttaacattcttctttaagaggtcgtcagtgtttgaaacttaatacacaattaaattattctgaagcctgcacagagtaagcacatacacgctagcacgaccaattaactgcacagcttgagaaataagaacagctctcactaaagatgggtagtaacatgggggaaaaacagaacagtaataattttttaaaaatctatagaaacttaaatgtggggactattaatatcttgaaacttctgaaaagataactgatcagtgtagcaactaatctgaaatcttaaaaggacaccaacaatcacaaagtaacccagttgtagaaaattccccaatgaataagtaatacatgcaacatggtgtaatgatggcaaaaatggtgggctaaggggacagtcaggctgagaaaattcttgaaagtttctaatgataatgtagaatcatcccaacttgcttcacttggctttttaatttctttttccacttttccagtcagtggatgattataaatgtcattttctaccttatgaatagagtggattttcaaatgcttatttgtagtgtttatttgaaggccagttaattacagtttaagacccctaaaaagctaattaataaaagacatcatgttctgataactaaaaggcttataaacatcattctgagtcctatgaaactgagtcctcaaagcacagattaataacaaatggcatctagcaaatctctagtaaactttcttatcataaaaacaagtttatgctctattattaaagccatatgagaaacagttttgggtgttttttttttttttaactacagtaaagttacttacaaagaaatgtgaaagataactggggtagtagtaataaaaattcattttgaaactgaaaaattcatattgtaatgtctgtgatcaaaggtcaacgtctttcaacattctcatacaagtccaacctggatagaaatcaactcaaatataatttagaaaaataacaggatatcaaacaatgtattaaaccccgtgaaatacaggcataccttacaaaaacaagaaatgaatattaaaggcaatttcaattacattgtttctgttatattttgaattgaatcccaagtgtgctctcattcctcaatacaaattaaaaataaacaactttaacagcatcaatggcatctggattacaatggaaatcatgaagtatatgagtttaacctgggtaaaaataaagcccaggcaatatgactgcaccttttccattccatgctgcaatcgcatttacatctcgaaattgactctaatgaccaaggcaaggtcaactagaaaaatccactcagctggtgagtcaggcacattgctcaacgtccgaaaggcctctcacaaagggttttaattttcaggctgttgcatcacagtgatgttataactgcactgcacaaaaataagtctttaacccagaaaaggaaattgtttcaaaaactacagtgagtgtgagaatacactttgttgaggtgcaaatttccccatctggttttcaggctctgcgacctgggctgcaaattcatttctctgagtttccatttcctcatctatgaaatgtggatgataacagagcccctcaacactgtgcctggcacatgcagagtatgtgtttagtaaatactaactctttatctcttttctgaagaatgatcagtatcaaaaggcaacgatgcctatcagttccaggctgtttttgctgctcgtgactcttactgaagccctgacctatgtcgcaagtgtaagggtaaaccaaatgaaaatttggtcaaaagggtcaaatatcaacagtttcacaggactggccttagttttcaggctacatataccccctacaagagagcttatctgtggggtctcaccatccactgctgatctcagaccacaaagttttagatagagaaatcatccaagctacagaaaatgagtcacagaatgtgtaagggaattggaaaaagctgagctattaatatggcaattgtcacgtcattcctgctactataatcgactcatctctctattccttcaagcagctccccaaaacattaacccaatgacttgggaagtttgaggttctgcaatcctgtcaggaattcccctcaaactgaaattaacattgaacacgatggcaaattaaaaaatatatatattattagaacaaaaaaagtatctcaagaaagatcttacagacttaattccaacacgaatccttactgttactgcgaagagatttacaaagagaaaaatgaaggtaaatacacacacacacacacacacacacacacacacacacacagattctggttcctgatcaataacacaggaaacatttattgaactcctcacaaccaactaagtcaacaggttttattccctcagtttaccctggagagtgatggaaatcaggacagtgttggaagataacaagctggggcctgggacccagggttcttgtgagcccagggcctgcgctcttaggatctgtacctcaccgaaacctgttctctaactactgcctgtaacaggagggaaactgattagggatagcggtgtagggtatgatgccaaagaaagcaagttttcggtcagttttcaacaaagagcagattgcgttgatatgcttcaggagaacatctgtgatgtctccatgaattactgcatgggtacaatcttggaagtctttatgcgaggatgaaagtactgtagttttacagtaggacagcagcgtctatgtgggcgtttagattttattttgaactctggagatcagtgttctctctcctctagcctttgaccacataaattaaaggttaaaaaaaatcggctcaactcaactggccaaagtcaagctgaggccttccttttaatcactatcaatactggagcgcctccacccccaatttctgtggccggtggacgtttggaggtttttcttaaggtctttttcacttcaagaatggagacgcgcttggttccgaaatacaatgaagactcttggaacaaaggtgtctgcaggtttctgaacctcaccgcagaacaggcgcggagtcaggcccctggatttgccctgttggaaggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgccacgcggcccctacaggcctgggactcccacccgagctcgcaaagtaggtcggggtctgaagctgggggcctagagcaactagcttcttggaaagcgactgcaattatttggggtaatatactctgttccagagacgtccaccccccacctcccacaaaaaaaaaccctgcacttaatttaaatgttacgttatatatacatcccatcatatacatatattcacacataatcactatgtaacagtccaggaagaaatttaatatttgggtaaattacatattcacacatcttcacataagtaaaaccagggtatccagacaaaaaaacaatctactaacctatatctgtttcccataggtcatatctggtctgggggtaaataaatacttctgacctcacttactgttgttatttacaaaagccaagaacagaagatgacacttggccattccctgctgttctcagagaacagcagtttcctaaagtgtcctttaaaaacataaatgggagccagcatccagcaaatcaccgggcgctgcgaaatgccttcctaaaaatacaatcttatcaaaggtctccgaaggcgtggagttaaaactacagcaaatggccttgaacttgtatttgcacacagccctggagaaaacaccagaaatagcactgcgaggccacaattgttaaaatgtgatagggctaaatttagaagaacgtgcgtttcatttagggcaaaagacacacattcggcagcatgagcaaactccatgcttacccggttgtctactttcctgtttaaaatatccttaaggaaaaaaaaaaaactgttatagtgacattcttaaaggctgagactgtcctactttctttgtagcaagattataaaatcacgtaattagctccctctctctatgctcactgccagcaaattcggcagttacataatgcaacatttccaggaaactattatgtgatttgtcttgtcgtgtctgaaaaagcaatgacaataaggtgagaaaaagggctgatcgaatggaatgcattaaaattaggaaggtggggaggtaaacgtcacaatggttcgtcccagatttaaaaataacagctgagaacattgaaagggcgaaccccagtagtacccaagatcagaattcaatgcgagcaattcttgcttttaggttttgtagtatcgttttaaaacctgtttatttgggacgtaatatagacgtaaataacgatctaatatccaacgctgcgcctcaattaccaaatcattgcacacatacgcgcatattcccacatcagcccgcaattcttgccaacatttcaccgtgggcagattatgcaatgtatgaaaggacaaatcccacaaccttcccgagggcttgtaaaacacgctgacgacaaacagggtggaaaacgtctgtgcagacacagcccctgacacaaacaaacgccgcgcaggcattctccgaatgccgtcaccgttcacgctaccaaccctttttctcaccaagcaaattaagactattccccattcctcaaccccccattcctctcccccctacgccgccagccccagagaaggaacgagaaagaaagacactagagaggaaagagcatcttcccgctcggagagggctcagcctgcctggcgctcttctttaccaaaacatcaattttcctgaaatcaggagacattatgcaacagcagcggggggagagcgcaaaccagccaggactacgtgccggcgcgaaggcgctgcaatcaaagcagccaccttaaggtggcgagtcccatcctgacaaggcagcaaaagtttatgtaatgaatgccccgcgcgcactcgccgccgctggcgagcccagcttacagcccgaccccgcacacagcgcggcccgcaccccgcgcccgcccgcccgcccgcagcgcgccctgggagcggtcgccgggcccccggccggcggtgggcggagcgcttaccgtgttcctgctctcgggccggcgaggagaaagaaaggggcggccgggagtcgggccgccggcgctcggggctcgggccgggccgggcctccggggccgcggcgggaggcgggcggcggcgagggcgcggcgcgggaggcgggcgggcgcgccgggtccgcgggcgccgtggccgcgcggagagatgtgtgttagtaggtcagttccgagcgccgcgctacgt

SEQ ID NO: 265 - DNA, 111 bp, Homo sapiens
cttttgctgtcagtttttctgttgcttgtcttggttttatgccttttatatcaaggcacataaaaggcataaaaccaagacaagcaacaaaaaaaggattgatcacagaag

SEQ ID NO: 266 - DNA, 79 bp, Homo sapiens
ttctgttgcttgtcttggttttatgccttttatatcaaggcacataaaaggcataaaaccaagacaagcaacaaaaaaa

SEQ ID NO: 267 - DNA, 989814 bp, Homo sapiens
aaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagtgacggacagggagctctgcgaattggcgcccggcaaggggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtccctttccatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagatgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagtttgtcttgttcttttcatctggagaaagccccatattctgattatgaaattgcatccgattttcaaagattgggtaattgagaggaaattgatccaattgaaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccattgcaaaacttgtgaatctacagaatacttttctgaaaaccactgaactacagcattgcttaccttatagttctgtcttattagtcatgtggccttgggcaagtcatttaactcttcctcttctggaaaataacaaaaatgatccctgcctcctagaagggtatgagataacatgtgaaaataacctggtttcattcctggaatattccataaatgatggctgttactcttttatctagttgctcaaaagagcacctgatggtgggaagtggtccaaccatgctaaacagttcctttcttcttgcttaacaggtttctatttggtgattaaaacctttctcaggcatttctttcccctcacaagtctccaaatatatcaagttcatctcttcctttctactgtctatttcacattcctattatataaatcactgtgttgcaattatctgtccatatatttgagctttattgagggctaactaatctagctaccagcatgtaacatggtgcctagtatagaatatgttatcagttatttaattggttcaggtatttacctgacttaatgggactccagtaacccgagtcttcctagtgtagcccccttagattagataaaaaaggatactcagacaagcccttttataaggtgtttaaaagctagtggcaaacaattgacttagaggttggttaagcccctcctccctttatcattctgagtggttacatagaatttaagattttggagcaatgattcattcaatatttattaactacctactgtgggccagtgtacactccggacttgagtctgtagaggggcactcttattccaatcagtagaataaacgtggcgtgagctttacagtgttcctctgggtaaggcaagtaatgcttaagtagttgtacttttaatctagtgctaattaatggcctcttaaaagtgcagtgttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgattcgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccatgttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggagtggggaggggtagcattgggagatatacctaatgctagatgacgagttagtgggtgcagcgcaccagcatggcacatgtatacgtatgtaactaacctgcacaatgtgcacatgtaccctaaaacttaaagtataataataaaaaaaaaaaaagtgcagtgttactctactctgtaggagggaagtggaagggagaacctagtatgagactcaggtctccaccctgcacttgactaggatgctgatttgcactcaggacatgcagcccttcaaggcatctcaaattacagacatgaaacaacagatgcctggatgaattttacaagcagggcaacagtgaggaagaaggctgtgtagcaaaatatacacttagactccagacctatggctttatcttgtcaatatcattaatattcacgggacccaagctaaggctgaagttagtgagccagctctgggtctggcaatgtactctagtgagaagatcaccggccttgaagtcaggcttgtgtctgaatcacagctctgcattttaactagctgtgtgacctcaggtgatcaccatacctctgagcctcaatttccctatctgttaatttaaataagggtgttggtatgtcaccaaaatcccttctagctctaagattttaattaatttgttaaccaatggaattgttgagttccccccaatgtttttgcataatctttgttataactgtgttttgtttacattagaatagtagaacaacaacatcaacaaaaaacccaaatcatccccaacttgatataattgcttctctaccccagctgttgtgactttgtgtcacttagctgttgtcaccctgctgagctagagttttccttggtaaaagaaaatgaatgacagtttatgttttaaagggctgttgtgagaattaaaatatataaatgggatagtatatgtaaaagtacctaattcagaaaatgtgtgacttccattatagggggcaaaagcatccttcccttcatggtgagttgttgatacacattcaagtgaaagccagtggagattttcagacctgtattggtgatgcaatagcatgttcagcacttcttggcctcttaattgaaaagcctattggaggaagagtgggattgctggaggggcagaagcaatactcattcacagcaatgtatcccattaggaaagctgtaaataaatcctaaagtctaatcatttgattaaagtaattaagatggcatcttgactcttttgaggggtaaatagagccaagatttttttaaagattttatatatatatgcactaatatgtagtacatacatctaagtatatacacacacgcacaggtagagatgaaattttttttaaaaccttagaaacatgcatgtttagctatttctttagatggctagcttcaaagaattttttctctaggtcaaaatttattaactcaaataattataaaaataaaagtaagccacaaatatccctgttaagtggttaaagcttgagctttgtaagcagggagtcctgagtttagtcctgtttccctcaattattagctctatgaccattaagtcacttaacctctcagtctgttttctcactagtaatgactgtttcacattttattgcagtattgtgaagagatgatggatatataaatgccatttagcagaataaaaagcatttttgaaattacagtaaaccaaatatatctgaaattacctcatttttgtgatataaagatgatatgaaactggtaagggaaagtctaacccctgcaaccgcaaaggaaaattatttactaactcactgaaatcttgattgaaaccatgaagagtttgtgtgaatgtatataagtcaaatgcatgttttccctatacagataaaaccaggattttcttgtggtgatttacccagtttacctggttataactataatggcattgcatattgtgaaagaatatcaaaacctgagattccatttattcactcacttattaaacatatataagacatctaccctttattattattagcaatacttaatatgagtaatgaatgcaaagaaaatcagtcatgaattttgtagtcaagtagcttgtggtctggctgcagagataaggtatgtaaacaaataataaaaaatacaagagagtaagataaatggtaacaggatagaaatggagtgccaagtgtttgagtaaagactgctgagaagatctggttgctgaagggccttaaaagtaaagggaatatcgtgaacaaaggtacaagattaggatgaagagtgagaagttggtgccagaagttaaaaccaccccagaatgaggggacattaaagaaattcaaaggtctaaagtggttaagtaataattcaaatggttctttttttttctgccctagtttatatgacttactgccaacagtacccatggctcagtgaggcttcatacttatagaggtggtagggtatgaatcagaatctccttagagtcctgagggtggagggcaaaggcatagtttgaaaatgcataccctcttcggtattctaatatctctcctgatggggaatcactgattgacattgtctcagaaatacattttctgtcctttaaaaattctgaaataatatcaaatttttctcccctcagaagcctacgccaaataagtgctgtaatcttagtacaactttgtagtacagtcagactcatttgttgatgtctgactggctgagtttttaaaacctattattcccccttccgccccatatctggacatgccagtaagaaagctcaaatgcttccacctttgtgcctggtggaagttcaaaccacctaagaatcctcactgcagccctacctccaagccactaggaaaagccaggctcctctactttccctgctcaagccatttctggacctgcttgagaactcgctgctctctgtaaaagcctcgtgtgagtgataaaccttttcatatctatttggtcctaatgtaacatcagtcctaacacctaaaccaagttttgggtaaggggttcaacctctcctctgtgggatgactaaacactttatgcaacaagcagagggtctaggagatgaccactaccactgcagggctctcctcttgctttagtttgctaactgactcttgctggctagaatttttttttttttttttttttttttgtcactgctggcaagctcatgctttgtgctgtgctgctttgtactgcgttcactgagccttaccaagcttctgttatagatgtgctcagctaagttggaatttttgataattggcatttaagaacaagaataaagtggcatttaagaacaagattaaagtggccctgggtcatgtgtcttggtcgagacttacctgtgtctctgaattgtgtttctggatcccagtgtcagctgtgactgtcacgaggctcagaggaatgactcttaccctgtgacttttggttgtttatctcaaccaggtgttgccctcattgtatggcgtactcaaaagaaacagtcataccctatgcaatatgcaggctggttggtagtcactcatggacgaagaccatgttgaatgctatggtgcacactcccaaaagcagatggtttactaggactttacaaaatgcctttcttcctacttctgcctatgccctatgccactatgccccctgaccaaaaaaaaaaaaaaaaaaaaaaaaaaattcctgatcctaagggttatagggaaaagcatccatgctatagccaaggagttctttcaaagccaacttaagcactgggtcctcaaaccctataaagcaactgttggcacgggagagaacctaatcctgattatatgtatttgcaactctggaggaagaatcttacacatatgagcaggatcgagaggaccttccctcctccccaacccctccccacaccaccaccaaatgatatacggtagccaccaaaaggaaaataaaataaacttggatactgggggaaagaaacaaaaaactaaaacagaggttcacaatttgacccaattggaaatccaaaattaaagaatttttgcaacaacaacaaaacaagataaaaggttactatttggcttttgtacctctacaacctaggttccgaattaacttttaacatttgctgaaatgcaccagttgtcaacccttcatagccttaatattgggcttcaaattatacctggaattcccctaaatttaaacaaagtacccctataatcttagggtagttaactgaggatattttaggacatgttaggaagacaaatagatatgcctcatcttaatcagaactattgccctgcctaaattcccccatagccatagcacccattaacttaaaatatcccatagtgggcatggatgctctaacccaatgagtaataaattaaaattgaattaagtctttggcacttacaaatcagcttgccaaaatgggacggcatggaccttcccctcctccgttagttaaaatagttaatatggcccaatttaaattaaaacagagtctttgaggtttgaaacccatataccagacctatttggagaagagtgactatccccactgcttcaccattaatggcccaatgtagcctgttcagaaacctagaaagaatgaatggcatctcacagtagattattgccatgttaatgctgaagttctatccaataaggctcccatatcaaatattatcaaaattactaactttaatcaacaactggtaaatacttttaattcatagatttggctaatattttagcagcgactcagccacaatttgccttcaccatcaaagggatgcagtatccttttactcagctactcatgggataacaacagccaggtcttcacacagcctgcagacaagatcttgaccacatttaactttcttcaggagcacagtaaacactgatcatactgatcacatcatcctccaagaaggttcatttggcacactcactgaggacacatatagtcataatcataaaagagctcacgaaaaagggatggaccactaccccacacaaattaccaagtccttccaccttggataaattcctgaaagctatttagctgagggccattctatccctgacacttgccagaaacagcattcgcaatttttttaaaagcccaatatgttttagtctattttgagttctggagacagcatatttctcatttacaaattttacttaaacccgtttatactattacttaagctcacttatgaattataatacaggcactgcaattagtgacccctgagagtcctttacttaaaggctttagcaacctcctcccatgattcctgaagtctctggcccacacttgatggccctaagttgcccacaggcatcttgtgccataaactgtcccttcagccccatgctatatgccattagagtgcaattgctggctgcatattggactctcctggaaacaggctggttgtcaccggccctcagcctgtgactctccataccagctgcccattatcccttgggtcttgaaatcacaccctaaaagttcaacatagccactgaggtttccttgctgtagcatagagccaaacctggcatatttcacctataggaaaaagtctcccaccaccaccctcagccccttgctaaataccatggtgctggtaaaagtcatcccccttcccagaccctttggatatctgtggaagcccttgcaatcaacagagtgaagagtaaagggagtttctccactttatagatggtatcactaccattgtatgtgatggagcttgctggaaagttcctgatttttagcccataactgggacatccctgataatgaaacaggacccaagtcagcacaactggccaaactttatgcggtccttttagcactgaataccctgaccaacatctgcacagttctatagactgttgaaccactgccagtgatttgctcatctgctccagccaatagcagcaaaaacagttttctatccaaggttgcctctttgggttaaataactctgtgactctcttgcctcatatatatatacttatactcaaagtataagtcaaggtcatttctactcacaataaatccacaataaaaggcctcattaacactttaaccccttcagtagtctagaaattattgatagtgactaaggcattcatttcacatctcaaaatacataatattgggctcttgtacaaggcatttaatggaactttcacctcccttaccagcctcaggctgcaggcctcatagaaagccataatggtttattttacctaaacaagttcaagttcaattaaatgaaacatgccacatttcagtcatcagtcaaatatcagggatgaatcgtaataaagattctgactccatttttggtacttgactgctaacaactttcaaattcttctacttactccctcttcttcagcttcacatctgggaaaactgatagggaagcctaggtaggcctacctttggtgccagagggaagctcaatccatgcaagccccagataatatatgagaacctccccaaccttaccctacacccctcacctcccaatccaagccagtctcctttccctgctttctcaaaccatgtttggacctgtttggaagctccctctgctctccctagaaagcttcattatgtgagtgatacatcttttcatatcttcttggtgtgtgtgtgtggtatcatcagcctcaacatctgaagcaaatgttgggtgggggtacatcccactacttctgagtgacaacagatgtttagagttaaatattgaaagaaatttcatattacgataaatgacaatttcagaccaggtgcagtgagctcacgcctgtaatcacagcattttgggaggccaaggaggggggaatcacctgaggtcgggggtttgagaccagcctgaccaacatggagaaaccctgtctctactaaaaatacaaaattagcaaggcatggtggcgcatgcctgtaatcccagctactcggggaagtctgagggaggagaatcactcgagcccaggaggtggaggttgcggtgagctgagatcacaccattgcactccagcctgggcaacaagagtgaaactccgtctcaaaaaaaaaaaaaaaaaaaaaaaagaagagaaaaaagaaagaaaattttgtaagttctgagcaaccacatgaataaagccatgtgttttgtgaaatgacgtttaatatttaaacttaaaactagtaataaatctctaaatctctcagaccccaagatatgaaacttgtttgacacatttaatgattctgtaaaagtgtaagaaatgaagttaaatgaagaatgtcatggcctgaaaggatggaaaggcattagacatgcatattaccttgcctgatccaagactcagggactggatatagaagaatgaaacttccattaattgatacactggaagaaaggccacatacaaataggcaaatataccgtagaccctgcatagaaggctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtcagcctctctgaatgaaataaaatgtctctaaataaaatgtcagaaataatacaaggtatggcagcaggaaagtagcttaagaaaacaaattgcaaaagggaacatttatttttcttctggacgataccatctttttctatgacttcaatcatgtatgcagctacataccaaactgtatttttcatgtcttaccttctttttgatcaccagattggtgtatacccagctgcccattttatattgccagttgtatataccttaggaatcttagactcagtatattcaaaactgaacttggctctaccatacctgctgctccttttttatttcacctaaggaactccagcagtcactcaggcccttaagtcagaaagcttggcaccatgtctaatcattttcctcacctttcaccttctactgtcccatcatgaagttctcatcattctagccacttaatatttttcacatacattaattttttttctgaatcctcatggctgctaaattttaagctattatttttctccttgaaacactactacaactccctaactgatcctcctaactctaatctagcatctcacatatacttcctcccatcccaagtcaagccctatcccacactagccagagtcaaattctaaaatgcaaatgctaatgataatatacaaaacctttaaatgacctttaagtgctcctagcaaaggtacaactttcttaacatggtctatacatcccagtgggatttgattcctgtccatctatctttctaggtttatcttaccaccacttccatcccctctagagctttgctccatccacaatttcttttttcttatctcagggacatttttgtacatgcttttcttgcatcttggaacatttaccttctccatacccacctgtgttggcctaaatcttaccttcttcaagtgttctggaatgcccttttggatccaccttaactgttttgagccaggtgttcatgccacactttatatttctccctctagcatttacatatttcatggtgatttttctcattaaatatctttttccaagactaaaatgagctctctgaaggcaaggcaatatttaatttactgctgcatccatagcatctagcacagtacctgaaacatagtaggcactataattgttgctgaataaaaccagaggtcagcttagctcatatgttgacatatgtgagcactctgggtcacaattagcatcagctggttatgccacctcctgcttctcctagtacctgcatccctgaatcattaagtctagctgcaatagaaagtggggtatggttgaaaggtgggaggagtggttccctctgatttgcttttccttagagaatcttctcaactgtaaaataattgaaagttgcgttcctttctagactcaacccgaactttgttttggtgcaatgtcaccattggaagagaaggctcaaaaatatacctttcattgtgtgttatatgaaatatatctcaataaagctgttacgaacgtaaaaatgtgaccttgagcaagtgagtttccacgttaggaaatggagataataaatgcccagcatacctcctggcatgtaatgaattctcagtacatgtcatgtggacttgggagtcagacagtcctgagatggaatcctgtctctgcctattagcagccatgtgacctttggacacatggccttttgaattgccactcaacacacttccttggatgggggaagaaagagagagtactaatcctgtttgagtcctaatattattaactaatggttctctttgggcaattatttttcttctccatggcactccatttccaccatctatatttgttaaattaaggatctttctagttgtaaacttcaatgattctggtgccccataccccggagacttattgaatcaagatctccaaaaggagccttctttctgggcatctgtggagtaggagggaacagcaaggaagaccctaaagacaaaggaccctaaagaggaaagcctggggcctagggctggtacatcagatgaagacaactaaggccagctcctacccaatgtatcaatggtgaagttgatctctaaggcccgtctcagagctggcactctgactcagagccaaggggttgctaggaaacaagggtctagagcctgctggtcagcatcatgcaggcttacatcctgccgatcaatctccctcttttttcgctcttcctgactaagtacttctaattgttgcagggagaagagaaatgccacacaaagagaactttgggagtgcccactttggctaagtaatagtaaaatgtaaatggtaagagaatcggagcatgaaaagacagaagaaagagaaggcatgagagaataccatttgccaactctgtgcctttgggttgtatatcttacccctcactcccaaatctcagtttacttccataaagataccaattttaggaagttgtagggattaaatgaaattgtgcatgtgaaatgcccagcatatctcctggcatgtagtgaattctcagtacatggcataaggacttggaagtcagacagccctaggatggaatcctggctctaccttttattagccatgtaaccttgagcagataagttttcacattaggaagatggaaataataatttggacctcacagggttgttatgaagacaatatgagatcatgtgattaactaactcataataggaactcaacacatgtaaatcattgttgccctttcctctgtcaccttctcttccaacacacatatacgcacatatatacattcttctagaacaatataagcttggtgttcagctgtgcaaacatgctcccatgtgccctactgctgagctccaggctgtgctatctgacattctcaccttctattcccacctccaggtttaggaaaagctcaaattcaaaagctgacagattagccagggagaaacagccatgacataggaagtctggcaggaagaagacatatatcttaggctgctgtagtcaggaccagaaaaggctgtatcattatgccttttgcttgagaaaactaacagtaataataatcattattggcttaattatgtctcatgataataatgaatgatgatcataatagcatttcctcagcatttgttatatgccaggtgcagcagtaatcactttacaaacatcaattcatttaaatctcataacaatactgcaagataagcataattatacccatgttaaagataagagaattgagtcccaggaacctaaaagacctgacctaagtcacacatctagagaatggaacagatgacacatagcttcttatgtatgttgccatttgttgaaacttacacctgtcgggaggagaatgcatcaatgactgacttgtgctgagttcctgctatgagccacgtaatcacatgatctcacatcatctgcataagaatcatgtgaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaagaatcatgtgagatctaaatgtttttccagctattcccctggtatctcccaaagtggccagttgttttcacttaatttaaggcattggagattcagtcttttctatttgtgacagttctcagctgtggacagaggcaatggaagtgtctctaactacttgggagactgaggcccagtgacattcaaaggtctaacaaagaagccaatagcattccctaggagcactgaggggatgcaggtactatattgctcctaactggtccaagagacttcgccattcctaaaggtgccaggccttcctacaaatctagctttgcattgttgtctccttgcgtggagtctccttcctccccaccttcccagttggcaaatgcctactcacccttaggttcctgtttagacatcttttcctccaggaagacttcccagtccaccctcagtaggttaggggcccatctctcagccttgttccctccactccccaccctccatacacatgcacactttatgctttcctctatcacagcatttatcaaattataaagcatttattaaaaaaatctgttcacctattagtctttcccatttgactgtgggatctttgagagcagggactgtgtctcacttgccttagcctccttagcacctcatattaggggctcaaggaactactgtggaatgatagagcggtgagaaaggataaaggaaagaaatgagaggcagacagggaagaacagggccccctggggtgtggtatctgaaaggactgtctgtgagcaaggctcctctcaggttggtaggttagacctgctgataatgaccaagggaaggcaaaaacttcaatgtatgtatctgtattccctccaggccattttgttctcattaaggggctgaaggcagagagatagcaaaagctccacattcatctccagggaaattccacattcttagtgccagactgctgagagaaaagggtcctatctaacaatcctgctccctcaggccctgcatctctgtctgggactgtgactgtgacaggggaatgagtatgattttgcacctgtttgaatcagagtaactagtttacaacagtatcaatctcttgtcacttcccctaggaagacggagagtggggatggtctccagtgctttaggtaatgatgcacacacatataccccaaataatataatgagcagtctgccaatcaaagactctgccatttataagtacatgggaggctttggcaacaggtagtctttgaatttgttctaagttttctggagagggaaggccaaaccatgtttctacctggttattaaatttctcccttcaccactgcaatttctaattgattgcataaagctgacctcatctttcccatctgtagaatgggaatggctaaccaagataagaatggaaaacaccttacacaagtcactatttcttactgtcacacccatgacagacattgctaagtaatcactgcattcttttccactgagcagagtcctggcccagaacctcaatgcagtattccaggcagttgattgcaatgggcacataaagaaaaactcaggcctgactatgtgattgctaatgcctcttcccactctgactttgtaaggtttgactttactttataatgcagccctgaagctaagattcagaagcagattatgctgggagatactggtggtaaagagaatattttcacccctgctcaagctgaaggtctaaattccaagtcttagctttcctaatttcttttacctgtggataagagaaacaacaggagagcaaatgtttacctttgggtttgataccaacatctaaagagttctctgaggctgctgtggtatgactgaaccaacaccaactccgtgattaatcagcctgggttcaaatccctgctttgccaaattccctggtgtgaatcctgacaagtcactttccccttctgagcctcagtttcctcaagcatgaaatgcagataacaatgcttgacttacagactttttgtgaggagtaaactggatgaaataatgtatgtgaaagtgctttgtgtgatgcactgcactgagcacatacagaggattattattcttggtatgcaccaataggaagaagactagggtgttccgttccagatggactcaatctaaaccggggaacaaatgcttttttttggtaatttcatcttgtggaaacggcagtctcatgggcctatttgtgtttaatgaaccacatcctgtatcgtctttttgcatggttctgaggagaaatacgttggctctgtcttctggcgtgctgtagactagtgagtgtcaagctcatatttaacctcctccagtctctctgccttctgcaagaaaacgcttccctagagctagattgatcctacaaataactgcacagaagctaaggcacaaagggagaggaaagggatagttagccaactctcaccaccatgctgggaccctaccatagacaaatgcagccaggctgggatttttcacctaggataaaattaaggagtttagattcagaggtgactgccctggggtcaagcagctaggaatcagaaaagccaggtttatctgagttcaaagtcagtgctttcaaattttcaacaaattgcttttaatacatcagtagtcttcatcctttctggagtcagagaaccctttgagactgcaagaaagctatggagactttcatcccaaataaaacacaaatgcagatgaacaacactttgcctataccactaaggcatttatgaccctcccaggctcactcaatctcactcactcatttatttcaataaacattattgaatgctatcaatatgccaggcactggctaggtattagccaagcaggcatggtccctgccctcacagagcttatagtgcagcaagagagaaagatgtaaactaataaatgtgaacttacaaacaggttatgtgtagcaaaggaacatcattctaagaaaataggaatgtagcaaaggatcctgacatagcctgaggcttcttgaaaggttttctgagaaagtgacatttgagttgggtgatatgaagtgatctcagcaaaaatgggaaaaaaaaatcagcagaaggccaagtgacaaaaggattgcagcttgttctaggacttgaaggaaggtcagtatgacaaaacggcagaaagcacggagacacacagggctgaagaggttggctgaggacagatcagaactgttagagccctgaggccatgggaaggaatttgcaaattatcctcacggcagtgacaaggcacctagaagttttaatccaaggaataacatgatgggatctctattttagaaacatcctataatggttaatttcatgcgttaacttggctgggttatcaaactatttggtcaaatagtattctggttatgtatgtgaggatgattttggagagattaacatttgaattggtagactgactaagcagattgtcctccttaatgtgagtggacttaaaccagtaagttgaaggccccaatagaaccaaaaggttgaccctcccacctgaatgtcttgagctaggacattggttttttcctgcctctggactccaatggaaacatcttcttttgttggatctcaagcctgccagccttcggactggaactatagcattggctctcccacttctcagggctttggattcacactggaattacaccatctgctctcctaggtctccagcttgctgactgcagatgttggaacttctcagcctcaataattatgttagacaatttattataataaatctatatcatctatatctatatttacatatctatacctgtatctgtacatatatatatatatatctgcctataagtctctcgctacatatccatcctgttggttctgtttctctggttttgttatcctggctaatacacatcctcagggctgccgtgtggttaggattcagggaggcagggtagatgcaggctgaccaggcaagagaacaaagctggaatccagacaagctatgatggtgacttggaatagggtggcaacagtgaggaagaaaaaagtgggcaaatttaagagttatttgagaattaaaattgacagaacttgaaatggtttggaaatgggtggctgaaatcagcagaagaccttctcagaaactaaggtacaaagggagagggaagggatagttagccaactcccaccaccacagacaaatgcagccaggctgagatttttcaccttggataaaattaaggagttaagattcagaggtgactgtcctgggatcaagcaatttgaagtcagtgctctcagatcttgagagagggtgttgagaaggattcctaggtttctggttctgcttctaaacagataatggtgcttctcactagaacactagaaaagtattaggttgtgtggagtggagtttgggcaggcaagagaactagaatgatagcaaatatcagaggaaagcttgatgttggaggtataaagtagaactcatcagtgtggggattacaacagagatcatgaccatagaaacaagtctagaaagaggggtccataagacaggctcctgtgaaacttcacttactaatgttgcagaagaggatgaacctgcagaggagacagagatgcaacagtccagaggggaagtagaaaatcatgaagatctagtatcaccgaaacaaacacagaaagtgcctcacacaggaagcagacaactttgtcaaagcctactgaaaggtcaagcaagatggaacccgaaaactgtccgcaggatattgaatcactgaggaagtaaaccaagaccttgcaggtctcagaccctaagaacaactccgttcatatcttgttgccatcttaaaagcaagttccctcgggaaactgaaggctctggagaattatccagctctcatcagccccttggccacatctgtcctcaaagaaaaggcgacagttgaataatcattcccttctcctcctccacccacaacccctgagatgccttttaaacagccaaaaactcctttaaaaagtagtctgggaatgtttcagctgacattcaaaagcacattgtaattcaaatggaagtgcagaaatgcaatcccttggacagtctaggaaaatgataatagagataagacaccttttaaaagtggcgacatgtatttatctgtggggacatttctataccatggactctcccaatctaaactcaggagcagtgcaaacttcacatagagaatgtccttccacaggggtcacctaggcagtacacttggaaaagacatgttaattgcatagcattctttcacttctagcctctctttatctcgccatttctctttgtggattttggtgtgcctttgtctatctctctttgtttttctgtctcctcctcccctcccctcttttctctctctctctctctctgcctttcttttcctctctttcttgctctagctctctgtccctccctctctctcacacacacacacagaatgaacaattctttcacatacacacatctgtcaccttccatagtcagtttctctataaaaaagaagcaattaaaaattcaaaaaacttattatatttctaattcctgcatctatcactatcctccctaagtagagaatgacaggggatgataaaagttacagattccttttgatatctccccagtccagttccacagctctttcccttcactggctccaagcctgtagctaaactcactgaggcccctcccaatcccaggacaatctacctctgcccttgatcctgggtcacaacgatgacaagggatgagagcaaattagcaagccccacccctgcccacacacatgtgtgccttcacgcacatacatacacacaaacatacacacctgggaacacagtaatcgaagtggatgtggcagccttgggtggagggcatgggttggatcaagataattaggccctcaactcagagctggatgggtccatccattgctctattttcttattccatctatacaatgactttgcattttgcatatggaaaaactgatcttaaagaatgaatcactttgctcaagatcacacatctgggaagaggtagagctgggatttgaattgagatccatctgattgtaaaacctgtgctttatctccaaatgagaaagtctttatccaaggtagccacaggaagggtgactttatacagtgaaccctcatcatgatataaagctcatgtatcatgatcacagctagggagaatgcgtgaatatcaagtcaaagggtgaaatggagccccagtgggaagaaggtagttttttcaaaatacagggatatcaagagcacagaagcatgtaatgaaagtattatgctagaggaagagactcagaagttcacacactgcttgggggaatggcacgggagcagaggtgatggctaaagaaacctgacaggctaaacagcttccatgctaatcatgtctggaacctagagcttccagggatgactttggctgctctagttgtttcctaaggcccagttcttcctgcattagattctaccttattgacctgttcggtgttccagtcccctacggactactggaaagctcagaattcccacctggtgatataaaactctgccttcctgcctggagatcttaccagtggttattggcatgcccagtgccccctctggaatcaacatcaaaaactaggtctgttattctagcttttatttttgccctattacagggaagaaaatacagaggatctagaccactatacttcctttctgtgtctagaatagacattaccaactgatcatctcaatgatcccaataacttacacacagtgttctagacaagccattccctagttgatcagaattggcacatgaaagctagagagcataatatgatagtgactgggtattccaaccagcctggaaatgttggcctcctccctcttcccagctgtctaccagtggatttttaaaagtctgtaacaaaaatgatgaaatattgggatactaaggcatgctggtaatgaacaacgtaggaacagagcctatatcttctttatttggtgccacaacatctgacgcacacacaaaaaaaaatacagagaaaaagcagttgggaaatgttcagacaatcaatgaataactatgactttattttcccacacaatgtacctttagaaacacttaggggaatgagagtaaagtaaactcctcatgggaaatattttaatcaggcacattcaccccatctcccttggctttccagtaatttccagtggtttccccagatcataaaagtggccagggtcccatcattatgaaacctgggaaggctagggcatttgtttctaatatccagggacaccagagctagggtgaaggaagaactgggctgaagtttggattcaaataccatcttcttggccttttgcctctgtaagttaaggtttccctcctgtaatgggggaagtgagtacccttgcctcctttgctttctggggtagatgggaagatcacaggaaggccatctggaaactgtagagggctgtacaaatgctcatggttgttatccatgccctatttggtctattttccccaacctactctaccgagtttgaccctccactcctcccttcactaagagttaaaatgacacttacaggattgtctttatctagtgacatctgtaattcacagataaaaatgagggtagaggctgggcgctgtggcttacgcctgtaatctcagcactttgggaggctgagatgggcggatcatgaggtcaggagattgagactatcctggctaacacagtgaaaccccatctctactaaaaatagaaaaaattagccgggcatggtggcgggcgcctgtagtcccagctactccggggactgaggcaggagaatggcgtgaacccggaaagcagagctttcagtgagcagagatcgtgccactgagctccagcctgggtgacagactgagactccgtctcaaaaaaaaaaaatgagggttgacctcacacattagcaaggtatggagctgggactagaatcctcagccaatgcccacaatttttactttatttcaagctactgttttctatgtacctactatgtaccagacattttacctacatcatctcattttattctcccaaaagccatgcaagagaattactatccctcatttaacacatgaggaaactgagacttagaagttcctttacctgaggttacctgccaggtgtgtagaaagaggagtaaagacatgaaacaccctccatcccacttcagcactgcactatctctcctcctctcacaagttctgcccaccgagttatcagcctccaagcccagattcatcctggcctggtttccaacgtttagcagatggcagtgacacataactcatggccggggagaaaaggggatactagctatctttaagtccaaaggcttctttcaactctacagatgcatatccccagcttctcatctcccattccctagcatcactcccaaatataaaaaataaaaccggagtatttgatctaccatctaggtggtcacagcaggtgaagatggaggggaagaaacacacacagaatggttaagctgacctcaatgcatcctctgtccttttcttgggagcaagtatggacgatggaagcaagaaaagtgcctttgcagactagaagcccaggaaggaaaacaccaagtttaccccacaagtttgcggcaaagccaggtcttgagggggacccctccagctgttgtttcagcactctttcttcccctctcccatcttacttgtaacagattccatgatccaccatacaaggaatgggattttctggaatgagaaagtcaagtctaaagtctgaagacagctaaggatggagaaggggtgggatttagaatcagagtagtgtcccaagccccaaacgtggtatgaagcaaattagttatgtagccacagtgagtgaaggtttttataaacataacctaatagtattacttcaaagtcctgaagcttattgccctgcttaatgatgtgtcacattatttgtagggtagcacaatgagacttctattgatttaatgcacttccttaaagactgtcattgacacagccataaaacggagctattcccagacaactcaattatatccactgtgcccataaaccaccccgtgccccacacagttgcacacaggaagcagaaagggctgagagcacgactggggatgcaaagcccccagggacaaaagggaagggatctagagattgggaagcaggtggactagggttttatccagttgggaatgtgcagctgcataaaaagcactagacaggaggtgtagagcaccccacttggtcttggccctgccaagcaaagctgcgtgaaagctcccttcttctcccctatagacttagtttcctcgactgcaaaactggagtgctatgctcaatgagatccttcagatccctcctggctcccacattttgtggttttttgttatgattgcttttgttcttggagatagggtggctgagctgtatgaaaagatgcaagcatgtttttaacattgctcttcaccctttccatcaattgagagactttcttttacaaatagttgataataatagtattaactatatcaagaagcatttcagtatagttgaaagagggaaagaacatgggcttttgcagccagccagccttgggttccaatcctgaccctgctacttattagctgtgtgtctatgagtacttgatgtggcatatctgagactcattttctcatgtgtaaaatgggagtatgaatacactgacctattaaaacacatatatacacatgtgcgatattctaacttcctcaaaatgctattacataaaccacttatctttaatgtgagaagcagacaagaatagctacttacgtacccatttcacaggaagagaaaattgaggtggaaaaggaataaccttcacaaggtgagtgggcagagactggtctccagcacctggtctgaggaattccaattctgataatagctgagagtcagaggaaaatgaaatctgctggcccttcctgaggataaaagcctcaccacaggacagaatggaaaccgtctgcttggttatgaggtgattgtttttccaaaggaattgagttcttcttgggagagaagaacccaagatcttcttgggttctcccaagaagcctggagagaagaaagtgtcaagaagacaccacttgctgacccccaacctgatctctggcagttgtttcaaagagaggatgtgggaagcaaagtacctgcaagagaaggcaagggttctggagtctagaacactaacttgaggcctcagaaaatgcctgacttgagagaatcctgcaaaatcattatacgatccctcactctgcccatggtgaaactgaagctcagagagaggcagggacttgcccatggtcacacagcttagacgtggcagagccaggatttagatccaaggcagctcagttgtctccccagaccccttgcctctatagcctgcctggccacctcctacagtaggcactccgggcttacctttctgatactggagccacagctgctgctggaccttcttgctgggaaagtggatgatgcaggtgagctctgagccatagagggcctctgcgatgtagtgggagccatagtgctggatgaaggacagcagctcctcccgactgctctccttggtcaggatcttgagaacattagtgaagcctggacaagagaggagcatgtggaggtggtcagatgtgagaggctggcggctagcaaattatacggtggcaggagttcttcccaacctgtattttgtgccttacccctcagcacagtggcagcttggtggctgcactagtccaaacatatacataattccctcacttaaatagcaatgaatgccctctctgaggggtacatcagacacggtgaccaagagggaatctgcaggagaagaaggcctaaactcagcaacgtagaccatgggaacttaaaaaagataaatcaagaagtcaaagctgatatccactcactgagcaaccaatgtgtactgggaaaactgttagatgtttcaccctctttatgtaacttaaccttagccacaatcatatataatttgacaacaacaacacccattgtataatgagcaagtcaaagctgagagactaaaattgagttatcttgaacttccaggtagagaaagaagctggactcaaacccacttatgttctcactgcacactgcatgcattttccaccacaccaaacaaaccagggcttgaactgcccatggctggaatcctaaggctgcatttgcccagagtcagcatgtattctgagtccatgaatctgattcctggtttagcttcctgtagcattgcttttctttatatctctgctgttccctctctttaacagtggtatgttctctctccctagatttccacagagccttcttgctgctctatttcttagtcctaggctaagtcctcagcacttaacatggggcctgcacagcagtcactcagtaaaaactgctccctctttctctccttcctcaaacaggcacatgagcaagctattcttccagggacattcctgagctcctccctgctactggacaaagcctagtgaccttctttagaaattcaaggttccaagctcatctctaatgagccacccacactaagttttagctccagccaaattagttttattatttatcctgaatgtgacctgaaatttctatcattctatctttccttgcattctcactacactcaacacacacacacacacacacacacacacacacacacacacacctgaaatggcctccctatgtcctccctaagtcacacctatgcttcaaggcccctggaagtcacctcttctccaagaagcctttcacatcattatggacaggagtgcctactgtctgcactttcaacatgcaccaccttaaagtcggaagctctaccttatttgtctctatatccgcacatgcatcctccctgcacacccaccccaactgggtacatggcccagttcctgggacacagcaaacacaccaaccacaattattacaagaacagccaacactgtgccacatcaaagtaaaatgtaaaagaacaagcttctctccagcattaaaagtgagctccaatttgccaacatttgattgacaaaagggttttccgggagcatcattattgattaattaaagcagatgcacctttgtacttctaacaggaacatcatagtcttattcacaaatgcagtgtggggtgtggggggcagaaaacaaaaatagggggctcaaagaatgggtgtttgatgagaacaacccctctccatcaacctgttaagtaatacaactgggtaattaatacagtagtgttaataacgagatggtttctgttaagtaataaaaaacaataccacagagatgccctgagggtcttatccaggcagacaaaactgcaatcaaatccttgattcattcattccctgctctgccacttactagctgtgtgaccttgggcaagttatttaacctccctaaccctcagtatacttatctgaagaaaaatgggataaataatgtcttcctcacagtactgttctgtcataagaaatgaactattataaaatgcttaacagatgtcagcaataattactatttctacttcccagagggtgaaatcctccaattcccaggctgtaagagcttcattttgctgatgaacaaagaaaagagaacaaaagacctcatagataattagaggacactcagacaataaaccagtgaaagtgttattagtaagagttagggtagaatatcctaggtcaggcctcatctttccagattccttcattcattccttatttttcagtcttcatttatttttaaaaattcctccatcatacatgagcaccaacaacgtgctaatctttgttagttttggagatactggaataaataagacccaagccccgcccacagttctcaggtcatagacaagattccaatataaatcaaggacttgttaatgtcttgatatagatatttaagcaccgagaattccgtgagttgttttgaggggaatggagaacgggggaggcatcacagagtaatatagtatatgttcccaagacaaagaggtccaggcagagggaacggtatgggcaaagtcactgtggcatgagagaacatgcaccattttgggcactataaattgttgccatctgttggagcttaaagttcatgtggatataatgtgggtggtgcatgtaaagggatgggggtgtgggggttatataagatttttgtatcggagatggacaggaaaataaattagccaggagagaaagagaaattggtgtctgaggagaatttataattcacaagcttgaaatacttcaaaaacataaatatgacttagatactgtttatccctactctcctattcatccctccacaccctactcagataccttttcctccaggaagcctctctagctcccccagaatgattagctccatcttctgtgccaccgcttccccattattgcatcgaccctactgtctgtcagactcctgtccacccaccctccctaggactccttgatggcagagaggatgcatcctcatttcctcagcatccccagtgctctcatatgccctggcacatgctaggtccttggcaacaagtgctaaattattccaagtcccctggctgcccaggcagtggtcctcacctgctgcgagggtgatggtgctgagcttcacacggtagaggttgctccggacccgccactgctgcaccatggggtaacccatggcctcatcatacctgatatctcctgggagagaaaataagatggtcacgtgagcccagaattaagacgcttcacaccacattgttcaccctgcagctcttggctctgggaaacagacacctctttgaagtacaactttcactgggattgacaattttatgaaccccaccctccaggcctctttctggtctctaatctcagccctacccctcatttttctctctgctctatagcttgcaagtcccctttaccctacaagcaagagcaacctcaggtcagatctatgtcttacctaaccccatttgcaatttgccaccaggcactagacatcccagtgcttcagtttccacatctgacactgtagctctctctaatactcttatttcgtaggcatgttgtgaggctcaagtaaggtaccagaagtgggagccctctggtaacctagaaatgttgtgcatgtagaccacatgtaagtaaactacagcctatttgttatgtattttctgtagctgctttcacactatgacagcagagttgagcagttgcaatacaaaccacctgcaaaggctaatgcatttattaactttcccttcatgtttgctgacccctatgtagactatcatttcttaacatggaaacatggatgttcataagtattatgtaaaatatacgtatacagaaataaactctttctatttcaagtaagactgagaagcacaggcaaaacaaagtttaactgtataatttctcagcatcttgattatattaatatgcatgaaagtagtgtgcaaacttctttgaccataaaaccccttttgtatgaaaggtcctttggaattcatgttttatagaataaatttcaggaaacactggtgtaaacaagaaataaaaacagaaaagacacaacgaagtgttagcaaatgattaactttgggcggtggtaaatgaaaaattcttgttttctgacttatattcacatctattttctaaattttctaccctaagctttgcaaactctcttttttataagctgaacaaaaatacattaaaaagatgctagtcacatcagcagttattattactgtttttatgtatccacactttcttgtgcctctgcaaatggcaggcacattttctatccttttctcttgtcccctggtgagtaggcacttaaagagatatttgataccaagattaaaatgagaatctcattggaacaaatgatttcttcctggacattactgcagtattaaagttgtccattactgtcaactttttttttttcctccttatgctccttagccttttcaggaataaaatagttttttagaggctttcattttaaagtaaaatattcatgatccccaaagatatgtccactggagtgaggttgtttgttataaatacatcctctttgtttatctgctctgcctctcctggccttcctttgcagaggctagggagaaaaggagattgtgtggagggaggaagggagggctatgtttttgactaagggcagagaaaatgtctgcacaagaagattcagacaccagggacaaggcagtctctgctccttccattactgctcattcatgttcaaagcagacttgctgggggcattggcagccaaggcctatctccaacagaagaggcagaatgatgcaggctgttgagaggcagctctttcacttggtggcatgatgtccaaacataaaaacaaaacaaatttaaaaactccttctgattatcaagtaatttgtaaaaccatcttctcactccatccctcacttccttccatctctgctcattcctggattcatgcctgaaataaaagcttctccaatggaatggatgtcagctttttgaggtcaaggtcacggtctatattcctccccttctacagagcctagaagagagcctggcttatagtagcctctcaataaatgcctatccactggcggcctaactctcactctgttcctaaccataaactcatccctgggttactctatcgctgactctcatcttgccctccccatctcagctccccacctggggattatggttggaatgaagctatgtgatggagggaggaatttttcctggtaataataataataataataataataataataataataataataataaatcttttgaaatgcaacagttccctttattaggaaatctccaaggatccttgagtcaaaacaaagaatcataacaatttgaaccactaatggatacccatagtgtgccaagcattttatatacatgatctttatttctcattagaatcctaaaaaaaaattatcataccctatttttttgttattgtgttttgttttgttttgttttgtttttgagacagagtttcactcctgttgcccatgctggagtgcagtggcaagatctcggctcactgcaacctccacctcctgggttcaagtgattctcctgcctcggcctcttgagtagttggaattacaggcacccaccaccacccctggctaattttttgtatctttagtagagacggggtttcatcatgttggctaggctggtctcaaactcctgacctcaggtgatcaacctgcctcggactcccaaagtgtggggattacaggcatgagccactgcgcccggcccataccctatattttagaggaagaaactgaggctcagagagcaaaactgtccaaggacataccaggatcaatgacaggttcaggggcctttccattaaagcacagcacctcctcacagaccgtggacatgtctgctttaggaggtagtaaactccccatcactgggggtatccaaagagggataaccactcaggaaggatattatagacttgattcctcattaggagggaagattagactagacaccttttgcagtccatgttagctccgaaattttatgatcttaaaaaaaatgaaaattaaggaaggcatagaaatttttgtaacattttacaaggtgtcttttacatccatcatttcatttgatctacatctgggtccctctttgaaatagcacaggtcaggggtgatgtaagatagtggatatgccatcagctttggagtcaagaccgactttgtttaaatcttgacatgactatagactagccacgtggccttggattagttcatgtccttgctaacaagtttaaaggggacaataatggccttgcagggttacatggtttaacacacaaaaagtgcctggcccccaggaccccttaagcacatgtgggttctctcctccatctatgctcttttacaggaaaggctcacgggagttagatgactcttttgaggtttcccagagcttgcaagtgatggggaagtcagacagagatttcaacctaggtctgtgagattgtggggtcttccctggggaacaattcccctctcagtgaaagagctctattatccttccccatgacgattcccccgtgactattctccctgggcagtggataaggcacacaaccacagtatcacaaaggcagagtcgagaacctcacatcttaggaaatttcttaagaaaagggtaggagaggaactgggagcaaaaaaagaggaaagagcatcctggggttggacagaaaatatggagtctcaggaaagcctgcaaaaggcaacttcccagtggagagagaaagtggttgcaggggtgggggagcggcaaagtggagtagaaagggcaaaagacttggtgctacagcacccaggttttagtcctggcagatatgctgtgtaactttggactggtcccttctacctctctaagtatagcttcctaatctatcaaatggtaaaaataatacccaccccacagatggcacagtgcccacgtacaaaaacgagctgtgtaactcgagtgctttcaagtaggaggggctcctgattggagagtccacttcttttactttggaatgacttaaaacgaaccaagaaaacaaaatactaacagtggaaaaataccagaaaattgtcaatgagaatgaaaagtgttttgagactcattcacagaggcaaaactctcactgagaaaaatcgttcctgttctcacagaggaacctcctctcaaagatgactgcagtcccaagtctgaggtctcagggaagtccctggttctgctcagccaatagcaggagcccaagaaagggtaagttccttcccatacccttcctcatgaaggaggaggcttgacagagcccatcttggatctgctgaagactgatatgcactaggtgtggagactcggtgtgtggtcagggaacctgggaagggtctggcacatgtgtcttaccagtgagcagttggaggtctggaaggggctcggagaggaccccccggcactgctcctccaccggcagcgggatcaccaacagcccatcggccagctggggaaagtccttgatgaagttgttctccctgtggagaggagcagagagactgccaaatcgaggaagtggagactgctgaggactacagggcaaggaggcaggatgctgtagtcagaataaagactcatggtggggtgactttgctgtaatgcctctggtttcctgaatcccagctctgagaacatggtgctaactacaggttcctgaatcaggcaggctggggttcaaatttagccccactgcttacttggctgtatgatctcaagcatgctactgttcctctcagaacctcagtttccttgtctataaagtgagactcagatctaagggctgttgtaagcacttaatgggaaaaacctaccaattatttaagatactttctgatgctctataaactgtatgtggccgctaaatgtcccctggcataagcagtggcaatgttgaaccaggatgtgagaactgagaatagtgcgtagtgtttgcagaacaaggggcaagactaggctgaaaaaaagaaaaacaaacaaacaaaccttggaaaaaatagatgtttgttaaatggaagggccctaagagacttttttttttggctcaaacttttccttttacagatggggaaactgaggcctggagaaagggaatgacttgctgaatcacaacctgataggttagactcaaacccatgtcttctgactccaggttagtgctctttcccttgctctaacttctttaggtgcctctaaccctttcctgcaggccagtcccagggaacagaagacagacctctgaatgaccccagaaaactgaactgtgaacaaagttctgagaggatggtagtaacagtgcagcagagggaggcaggtttcattcttctagacaatagacctgcctaaaaattaacagcctgccaagagaggtggtgagcttcctgttactgagggtgtgcaagcagaaaacttggcagccagttggcacggatggtatcgaggtcttttccaaattaaatatgacttatgaggtccctttatattcagaaattcccagcattaaagacatgaattatagtctggagaggaggaggagagaagagaagggggaggagaagaacaaaaggaggaagatgtttattacttcattttgacacatggaatggtcaaccttgaaatgaaaatcagaagcacgaaaacaaaaatatgtgatgccaaagcaatgcctttgaagcctgtatctcagacagttcaaaagcagctgtaaaagtgttgagtggcttgggtcaccttcctgtctgctcaacatctctgcaccccactccaggcacctttgaagctcatcatcaattcatccatttaatgaacactttcttcatttctgagtccagaggatgtgacattatcaccatcttctataccaccagcatcaccatcattatcatcattgtctttgtcatctatattattcattgaatctttataatttgctaggatctagctaaatactttacatacattttatcacttaatcttcacagcaatcccaaaagatagatattattatctttaagttgcagacaagtagcatgagatttggtgttaacaggtggtggagctgggatacgaacccaggtctggttgggcctaagactgtctgcccaggcatgcacgtgcatgatggtgagttttaaggcccacacttgccatttaaacatgctgctgtgtgtgggtgtgccatggctgtctgtggagtcatccttgtttatgtctgtgtgtgcctgtgataatgggttctacctagatggttggtctttgtctacaaatctgggagtgtggaacagcaatatgaatttaaaaagacaggcttctggtagatggaagtaccaccacatagcatataaccctagccaggactaaatgtcctcatgcttcccttgtgaggtggcctctggtgatagatttttccctgaaagatgtagcaggatggaggggtagtccatgccctagtcattcaaccagcatgcactgagcacatacttgggtggaatcctgtgctgggtggtgctaagaacacagagacagattgatgtttccccttgtcctctagatcttctcagcctagtggggaaaacacaaaaaatggccatgcagaataatcagtgggggctgctatcaggaattctgcatgtgctgggtgctgctgcacaaggtctcttccctacaagatccccagcacttgttttcactctgggcaggagaggctaagggtgaggaggtagctcagccttggaagctgagaagagcctatgaggactgggctccagttctgcccacactgcatcctagctgtgtaacctggagcaaaccaaccaaatctcaaggttctgttctgtaaaatggggatcataacagctattcagctggccttagtggaatggctacaataacaatagccttttattgagcacctactatgcaccagacacaattggcagtacttattcttcacccaactctgtgaagtaggtgtcatttacattccccattcagacattgaaaagctgaagcacaaagaagttatgtaactacctaaagccacaaggctgggaagtgggagatcccaggtggtttggccccagatcaaaattgagtaatatattgctttcaaccatgagttaagttttaaagttgattcaatctgatatttaaattttccagaattctatgaggtttaaaagcaaactaaatgcttaagtatattttatactttattatgtactaaaaaatgaccagattgtggtgttatttctcagcttgcctttccctaagcattcactcagaaagttgaatatagaagggttaatatttattgtatgcctggcatagagtctttgtttgtctaacaggtcatggtagatgtcttcaaaagacatcctagcactcctcatcactgcttgggtagagggtgctaaaggacctgcctgtgacacacacagactgtcagtgttggaagggccatagtgcctgggcgtgtgctgagcccagacaggatgcagccaagaggaggaccttgctgctcctacaagagaggagagagttagctattcaccacatgccccaggctctgttctctatgtgacctcttcaagcctcacgcaaatgccacaaaataggcatatattcccagtttaaccgacaaggaaatggattttccatggacttacataatggatgcatttgggaaatgaaatctgaaggcaaatctatcatttttcactttaccacccaagagtgtccatttcaaatctctagaaatgttcttacaattgtagagaagggaaggtaatgccaccttctctatccgcatgtccctctcttccaatccttctgccttcttatcaagtcactcttagctctgcaaggaaatctgaccccaacgggacaatgcaaggaagtagagtgtgcaaactcaggaggcaggggcctggctcaggacaccccttctcggaggaaggttttccttcctgagcttccagaaagtagaggggggacttggagaaatgcagaaagacagagaagatggaagggtgacagttagccagccaatatggaagactgggaagaagggtggcaggtaggcggagatgaagcccgaatgaacagcccagcgacggcatggtctctcgggtactgggtccctttgcgaccgcctgggcgatggccacaagtcctgcaaggcctctgccagcagagggcgcccggggcctttgcatcgatcagctgtttcgggaggcaaaacatggatgagagagtagctgctgggaaagttccgctgggctgagaacctcagatggaagcctagacaacagctgcagaacccacccacctgggagaggcgaccagggagctggcagggtgctggcttaaactcgggtgctcaggaataattcagattcttagcgctcgtgtgtgtgtgtgtgaatgtgtgtgtgtgtgtgtgtgtgtgtgtgtagtaaaaactaccacacaactaattcgtataataggaagacagaaataatggacaatatttatttattgattatatctgttgctcatcagttatgctgtagctcatgtgccaacgtgtgtgtgtgtgtgtgtgtgtgtgtgtgtgtgtgtgtagtaaaagctgctaggtaactaaccctagcaataatgataatatttacagagatttattgattgcatttgttgaccatctcctatactcaaggtagtgtgtcaagatatagtagcgtacaggaatggaaaaccaaaggttgtatgttctcacttataactgtgaactaagctataaggatacaaaggcataagagtgatataatgagttttgaggacttggcgggggaaggttggaagaggagtgataaaagactacatattggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaagactacatattggggccaggagcagcggctcatgcctataatcccagcactttgggaggctgaggcagaaagatcccctgaggtcaggagttcaagaccaacttggccaacatggtgaaaccccatctctactaaaaatacacaaattagctgggcatggtggcacccacctgtaatcccagctactcgggaggctgaggcatgagaatcatttgaactcgggaggcggaggttgcagtgagctgagattgcgctgagactccatctcagaagaaaaaaaaaaaaagactatgtgttgggtacagtgtctactgttcagatgaagggtgccctaaaatctcagcaatcaccactaaagaacttatctatctaatcaaaaaccacttgtacccccaaaacgatggaaattaaaacagatataggagtgtgtatgccattttaacctcataagaactctgtgagacaggtactatcattattcccactttatagacaaagaaacatgttcagagaggttaaggaacttgtccaactgaggtccatggtttgaaagtggcagtggccaagaccgcattctaacccctagcttccagctgagagcccagcacgcagtaagtacatgctcagtgaatcgatcccaagcctgtgctcttgatccctggcatagcttgactcatttagagatgagaccaggcagttctgttattcaccaccacagtggagtctgctttcaagaaagcatttttgagagatgcttgtttaaacaaacagtggctctgctgctgcttgaaacacaacattcacttacacacacacacacacacacacaaacacacagataagcatctgccaaatttatctataaaaacagttcaatctcagtcgacattctagggaaacaattcatcgattctaaaatagtagatcttgggccccggggactctggcagtgagaggtctccttcatttcacaaacacttattggagctctaacctttttcaggaactgttttgggtactagggatacagcagtggaaaatcagaggagatgcctccattcatgaagaccaggagagaatcaatgttgcattgaggtctacaagatccctcattatctagaccctgcctacttactcctgctgccttattgtttgagccacagccccctgggccactgttttcctcctgctctgactgtccttaagttccttttctggggcatgctcccatcctacacaaggacccacttagaatttgccctctctctggaatttgccctccctctggaatttgccctccctctgcacctgaacaactcctactcatcattcagaccatccactattcctctgcctttgagaactctcgctggaatcagttcttccattacacacccttatagtatcttgttgttttccactatgaagggctttatcgtttctaacgatacatgtgctcatggaagaccttgttggacacctgtctttcccactagactgtgagttccatgcagccccaaactatgcctgtccaatgtactgctgcctcctcagggcccagcagtgcaaactgagtgcctgagtaaaactgagaaaaagtaggtgcaccatgagcatttgttgaagcagtgaaggaagaaaacccagagacaatggtaatgtgtgcatgaccacatctattatgaagccctttctgatgttttgccagagtctcagaatgcttcaggatctaaagcatattgaggatttgagtctaatattccataagaagcttcaaaaccctactttcttaccctaaattcctgagtgcatacatactctggctcccatggagcttggacagaggggccaggggccactgagtgagtgggaccagatgagaaaagatgatctccctaagaaaggggttggttaaacctcccattcttggtgtgcatatgtgcattcaggtagaggtagtggtgtgggcacattctaaaatgaacaatgccagtgggcagcaaaaggccccattcaaaaaccatcatttccataataccattccagttttccccagttgaaatacatcttttctatcactttaatttcatgcatcttctttgtagattccagatgtggccttgggatctagtgatagaaagagcatgggcttagaactcatacgcacatggatacaaattctagctgtgtgaccttcaggagtatcacttcaaattttatgatccttagtgacttcatctgtaacatggggataatgagttcagcttcaatgcgtgaagaggaggatttatgtaaagttattttattttatttatttatttttttgagatggagtcttgctctgtcgcccaggctggagtgcagttgtgcgatcttggctcactgcaagctccgcctcccgggttcacgccattctcctgcctcagcctcccgagtagctgggactacaggcgcccaccaccacgctctgctaattttttaattttttttagtagagatggggtttcactgtgttagccaggatggtctctatctcctgacctcgggatctgcccgtgtcagcctctcaaagtgctgggattacaggcgtgaaccaccgcgcccggcggtaaagttatttttaatgctagcttattttcctgaatcccatactagattctgaatctctccaaggatctcagagggcccagcacagtgcctttctcactgtatatgcccctgagcatttgttgaaccatgtgtaatagaaggggaaggtctctttaccctcccaggctacctgcatatgacctctaaatgacagaaatcctacaaagcatttccactgagatgcactgtgtctagcttccttctgatcagccatgctgacagcaaagacaaacaagggaagctggactcctctgccactctgtcctacccttcctcaggtctttgctgcctgccgcccccttttaagaatatgtgtgttttgggtacattaatacacagcagccagcatgcaagagccatcacccctcagttctagggaaattagcatttaaattgaggtattccaggaaggtaaatcaccttagagccagccagcactgtctgcagtcttttcttacttgagggaaagctaggagccttggcttgggagctattgagtttgcagggaggggcttgctctccttgcctggttctctggctcttcctacactgcccataagcctcaaaaaaggttgccttaaaatcccaaagctgatgaggacatattccctggtgtacactgtgcctcatcccccctctctgactgaactgagcctttatgccaagtgacaggatgactttggctgagatttggtgtcctctgacaacaagcagttgggagacctgtgttctcatcttggctctgtcactggctggctgtgtgatgtgcagaagccactgtccttctctggaactgagaagaatgggctggtacaaaacgtttgtctgaacctcaagctgggaggtgctgggctagattttgtagctgtcctgcaggtgccggagacatctatagggtctggtggtgataaattgatgctaacactggttggttggtaccagcccaccctgaagctctgccctcttaagcagcagttagaaactgttctcatatgctctacttcttaattatgcatcatagtttaagttctctggtcaagcactcaatatttagtgattccttcatttaaccattcattcgttcattcattcattccttcattcattcaacaaatatttactgttatttgtcaggcattaggaatacaacaataaaaatgacaatctctgtcctccagttactcacaggctgataggagacgcacatgtgtacaaatgccttctatgtatgtgtgcacatgtgtgcaaggtaaatcattgttttgaaaatgttaaaatgtttttcattctccggaaatcctatttcagctttgcctctcaaagttgactttgcagtgtttcaagctggacaatagtttcaaaacccagcctgtgctgagggcgaagttcccttctctatcaaaagacagacctgctgactcagatcattatgttttattttaatatacagattgggcaggtgatggcctcacagttgtacccaccagataagaaaaggaaatagtacactcttctttctgccactgatgctgcaaggaattgttgaagaggaaagtcaagtggctgagagttcagatgggagtgcctcagtgaccctcctcctggccttttggaagtcaaaccacccctcattcattccaagtacaagggtagtgtcaataaatgcttaagatatttaagaatctcgatacgggtgagcaggggtgatagggtttgctcccctagactcaggatatagtctgggaagtttgcaagcccctcgctcaacaagccaacaggagctcctgggagagggtagcagtaagtgaagaagagacttgaatttggagccacccatgccaagttctgcatacacagggtaaaggggataaaactgtcaagacttcctggccccataaatatgtgcaattgttatatgtcaattaaaatataaaattaaaaataaaaagacttcttggcataactccttcgctcccatggtggcagggatggtagatgaggctgagattagaacattagaaccaagggggcttcagagtgttgagacctaatgaccttggacattggctgtgtgttccaacacattgcttctctcaaaaaactacccaagaccatccatacctcaatggatgccagtgccagcgctcagagccaagctcaaacaaaaaatcacatagcaaataccagcaaggatccacaagaacacatttgtaccagagaccttccctcaccaacctctgccttctctgaggccaagttaaggggtaggggagactgtttggtaagggggagaggcaaggctggtggggagaatgcaactgaggcaagactggtggggagttgaactttgagtggactaaacgtttaccctagagaaaatgttttgtatccttaatcaaaaaatggaaatacttggccgggcatggtggcttatgcctgtaatcccagcactttgggaggccgaggcaggcagatcttgaggtcaggagattgagaccatcctcgctaacatggtgaaaccccgcctctactaaaaatgcaaaaaaattagccaggcgtggtggcggacgcctgtagtccacgctactcaggaggctgaggctgaggcaggagaatggcgtgaacccaggaggcagagcttgtagtgagccgagatcatgccgctgcactccagtgagacgggatctcactctgtcgcccaggctggagtgcactggtgtgatctcggctcactgaaacctccatctcccgggttcaagcgattcgcctgcctcccgagtagctgggattacaggggtgtgccaccccaccgagctaattgtatttttagtagagacggggtttcaccatgtcagccaggctggtcttgaacccctgacctcaaataatatgcccacttcgccctcccaaagtgctgggatttcaggcgtgagccaccgtaccaggcagaaacatgtttttgctatcagtggaatgaaaacttgagagaattattatgtcagttgtagaaaattaagacaacagtgtttttgtatactgagttgcagcaaaataatttttgaatgcttgactgtgagaatggatggttataggttagagggataaagtctaagtttcatcgggaaagttcagggacaaaggaaatgaagagaaggaaaacttaatgtagactgaggaggtcaggaaggctccctggaggaggtgagacttgacagattgggaggggttaacaagggagagggcagaaaaaggaggtgagggtggggcctaggcagaaagaacagcatgcacaaaagtccataggggtgtatgtgtgtgggcgcatgtgtgtgtatggaagaggcacagataaaacacatggcatgttctggaaattgcaataagctaagtttcaagatgctaaagcagcgagtgagaagcaaggatgggatagggctagaggaggccacatagggatcagatctcatgggttttctaagtgatgctacagaaggtgggcttcattctaagggtaaggagacccactgtagggtattcagcaggaaagcaaaaccatcagataggagcttcaaaaagactgcctgactacagggtagaggatggactgaaaaaaggctggaaggagggagaccagttaagaggttttgcagtaatccagacaagacataaccgattagatggacaacagaatacagagaagaggcacagatttgagagagagtcaggaagtagaacctgctgatctccattgccaactgcacgtggtggggagtaaaagaagagtcatgggatatattgagcaggtttgagcccaagcagtcaagcccatgctcctgtgctgactccagagacctgcctccccagtatttgcttattattagtactaataaccagagccctccacacatgcctgagttcattaaccacagctagaaaacagaccaatgtgctttgtcccatcacatatgtcctcggcctcctttctgcctctgctagctgtcagtccacctcagcttaactgctaactgtgagacccacaggaagatggccagatctcaagcctaacccccagcacttcaagcaggccaagtcaccacccagacggaggctctcagaactgcaatttgctccctagcagaatgcagcttgtgacccctactgtccagggtgtttcaaggaccatggctgcaaagttgctttactggcctatccagtggcccatacccatgggtccactctaatcacatctgatgctcctagaaatgataagcattactgttaccatttgataggaaaagaagcagaggcagtatagagaagtgtcttatttaaggccttgcaggtgttttcttggcagaattggactgactaccaatccctattcttagtttccaatccagtcctgtttcgacttgtgcattctcaagggttaggcagagtgacctctctacctgcctgataccttctctgaactgtgaactccttccaggcagcagctgtatttgtttcttctttgcagcctcctctgcgctctctcgtagacttcccagacagacctcgtggtgtcgtctccttcaggaagctgtcactgagtcccttctttggaagcaatatccttctgtttccacagcacttgactttggctctgatctcaagatcaccaactctgctaggtatgattgttctctgcacgtgtttcccatctcagattcaatggtcaatgctgcaaggatctatataactagtttccctcagagccctcctccccacagtctgattccagggtttggtatagacacagtccctaatagctgttcttgaggccatcatcccctctcatagcgactactacaatgacctgttaactatgctttctgaattcagccttgccccttccaattcatttactatcttgcagccagaacgattttctgaaatgtttctaacacaaatatgtcattagctccatgtattagcattctattgcagctgtaaaacatcatcacaaagttagaggctcaaaacaacattaatttattttatagttctctaggtcagaagtctgacatgggattctgggctaacatctaggtgtcagcagagatgtttctttctggaggttctaggggagagttgacttccttgcctttcccctgcttcttaaggctgtccatatggctcatggcccctttcctcaatcctgaaagccagccaaggcaaactgagtactttttttttttttttttttttgagacagagtcttgctctgtcacccaggctggagtgtagtggcgccatctcagctcactgcaacttccgactcctggattcaagcgattctcctgcctcaccctcctgagtagctgggattacaggcatgcatcaccatgcccggctaatgtttgtatttttcagtagagatggggtttcactgtgttggtcaggctggtctcaaactcctgatctcgtgatctgcctgtctcagcctcctaaaatgttgggattacaggcttgagccaccatgcccggccaattgagtccttttcacatcacacactcttacttcatcctatcctctgcctccctcttcctctttaaagatccttttggtttcactggggcctcctggttaatccagagactctcttcatctcaagatgagctgattggcaaccctattccacctgcactctgaatgttttcttttctatgtaagataactgataacttattcatgggttccagggattgagacatggacatcttgcattattctgccttcacattctaggtttttttcttttattttcagttttctttttccctaggaggactttgtcaatgcccctcttttcatttgggagttagatgttccttctttgtgtttgtgcagcccctgttctgctgctatgctagcattatcacactggactgttgttcccagtcaccctctgtctccctcattggaccatgagcactcgagagcaagaactacgtctgtcttattcactgctgtgcacccagccctaacgcagtgtctgatgcatgcactaggggctcaagaagtgcttattcaataaattgctgaatgtctcttagctgaatggcaatgtaggggagacaatccattcagctgtggtaccgcgatctccctcccatggggcctagtcactgccttattcatctctgcctcccttgccgtccttccttcacttccctagatatctagcacacagaataacaagtatcatttttaaagctaatatctattcatcgtttacgacgtgctagacattattctaagggctttgcatatacaatctcatttcacatgcacaacaaccatgcaaggtaagcactcttgttctacttttatagtgagggagcagagacataaaagaggaaaaatgcacagaacttataaggtgaggtttgaataatctaacttcatgttcttaaacactatgcaaaaatatgctggtgaatgtttaatttttccccaaatgaaatcctgaaaagtaaaggttgacttgttgcaaatgccgatgctggttgaatgtcttagatggatgccctttgttaaacgtatatcatgtgttaggttctctgcaggctttgtttccaaccctctcaacaaccttgtgagttaggtattattatctccctgccagaggtgggggaactggggctcagaggggtgagaatcactttcctggagtcatgtacaattgaatcagggccatctgcctccactctaccacctatctctccaaccatagtcacacttgtcttcttccctctttactgcccaccctcatttatacacaggtgtgcatgagcacacacacacacacacacacacacacacacacacaccacctacccccatacatacacagagtcagagtgaagcctgggttacacaaagcacatgtcttccctctctaaatgcaaaacaatttccaccagtggcaccaaactcacttaagcattccaggcatggctgttactaactcctgccctggtaattgcgatccctgaaattgaaagaaattgcaggctagaggaacattatcttctccttggccacttcgccctccatctcctttgcctgtgtgtattagcactgggatcccttgtcctgtcataacactgagaacaagctgagctgctgtcaccagggcctcttccagaactttcccctccactactcaaggaagacagtgaaaggccctcacaccttgacataaaatttagagatgtggctggagaaaagtcaacattactaggcatttttctgacaaagtattatcattatatctgttttccagatgctataaatgagattcagagaggaagattagccctgccccagaagctaaacacaaattgaaacctaaagatggcctccttaacagatctgcagggccagagtgaataattccctggttaaaagtggcagctgagctccttgatgagggggcacctcttagtccaaccctcctgctccagctccagccttaatcccaggactgcaggatgcagactgcctccctcaatccccgaggggtctagctgcttactttatcacagccaagggcagaagcccatatccctgtaactttcagtatgtttccagttcaattaggatcttcatattccagtattcagagtattttctaatcttaggaatcctctatctcacaccaacatttcactacacactcctcaagggcaaggcctggactccattcataccattggtatctcatgggtctagaataagagcagacacacagtaggtacacaaaaaacacttgccagatgagtccaagggtgaaggcgactgactctccctgaatcctagtgcatgttatcattccttatgcacccagtcctgccctggacagggagccaggatgtccaagttttacgaagctgtgccaataacttgctgtgtgatcttgagcaagtcatttcccatctctagggagtgtttaagtcctgaggtcatttatttgaataatgcaagtgtccccaaatggctccagtatgaagggctaagagaaagttctcaagatgagaagacctattctcatggacaccttatgtcttctctctcacctttttggaagtagtctttgcagtcacacacctggatttgcatcctggtccgccccccgtcccctgtgtagatctagttggacaaaacattgaacctttcctggacctttgtttcctcatcagaaaaatggaaataataatcatccttgcctcacatacttgctgtaaagatgaaaagagcccataaaatgaattgcttagcagaagacctgaaaatagcaggctctcaataaatggcagctattgctgctgtaaaatgcaccactctagcacattttaatttaacacactcaaaaagcttgttgtgattaggcataagaaggatgcaaatggacctgaaacccttttcttctcctcctgccctgacagcatgcacaatttgtccaagccacatgagagagctataatgagaatactggacatatggtcactaatttggggttattttctttacgtcatgggaatccttcccgcccgccactggtaaatttgattctttcctaactacagaacttacccacaacctctggtggagttggtaaagctaaaagcaatgctcccagcaccataagttgaatatctctcttcctatcacagcatgcactgaaattgccatggtgtgtctatttccctacttttggggggcaggaactaactgatatggtttggatgtttatcccctccaaatcccatgtggaaacataatccccagtgttggaggtggagcctgttggaggtgattggatcatgggggtggatccccatggatggtttaacaccatcccgttggtgacaagtgagttctctttcagttagttcacacaaaacctggttgtttaagcgagtgtggcacctccccttctctctcttgctctcactctcattatgtgatatgcccagctccccctaccttccaacatacttgtaagcttcctgaggcccttcccaaaagcagatgctggagccatgtttgtacagcctgcagaaccatgagctaattattcctcctttctttagaaattacccaacctcaggcatttccttatagcaatgcaaatagtctaacacactaactgtgttttctctctccttctgcagctcctaacaaagtactgggtgcatacttgatatccaattcgaaaatgtttgtagatgagccttcagtagactggacagcaaattaaagaaaaataacgtttaaaaactcttaaagcaaaagatagaaaataatcaaagccacattttaactgacgacacagcatcaattcatttgttacttcattccttgtagtagttagaaataaagaacttttttgaatgttaacatttaaaaccaagccataacatggactttggaatcagaacatatggcataaatacagctggttctggtgtgaatttgtggttggggtcgcatttctgaaagtttcttcttcccttttgtctttcccactctccctggggcaccttagaagtctttccatatagccacctctaatgagctttgcaaaatgagaaacctgctacagtagaagaaaatctaatagcaattgtttccttgttcactctctctctctctctttcttctctttccctctctcttttattagtcattagcaatggagaaagaaaacacccaaaggcagtagaaagacagtaatattcgcacgtgctttctgcaacactgcactaatgaggagccctgaccatcttgcatattccttcttattcaattccaacagtcctgtcataagttggagccacaagcagaacctagctagtgtggacattagccagtttgcttcataacaaaggtgaagtgtacatgctgttacaggacagctggaaattattgttaagtgctccttaacaccaagggatatcaagactttaaaagggcctagaaaaatacaaatccaattaatgaacagaatttttgttcttttcaaaatttgacatagaaatgtaattgaatccagtttgtaagaccctggatccagcttcccaccttcttagatactggttatgttgccatatgcaatcatacagtcatgctgagcctcaggtttgtctataataccctactccactcatagagagagggccttaaaccatacctcttactagatgtgctatcctaagcaggctgttaaatttcaggagcctcagttacttcactcataaaatgaggaccgtaatagtacctacttttataaattcaattatgaggattaaaagagactatgcatatagatagcctgtgtgcttcatggggtggtaaaaggaacaataactataaacagcctatgtatatatttgcctgtgtggtagttactgttactgtggttatttatttcctagtaagaagttcagagttaaagttctgcttccactcttgcaagtttggacaagttagcgtttcttactaagtttcagtctcctgatatgtaatggggacaaaataacagtaccagtgttgctgaattgttgtggaattaacaagataatgcatgcagcatggcacctgacacattatactgtgtgctccataaatgttaactattattattgttattattattattattagaaatgtgatttagggtttaaaaaataatatgcagcagaaaatcccagagaatccacaacaaaatactgctggaattaataagtgattatgacaagcttgtaggatacagatttacatacaaaagtctattgctttcccatatgctggcagtaatcaattataatttgaaattaaaaacaaaacatcatttacattagtaccaaaaaataaaatacttgggtataaatctaacaaaatacatagaagatctatataaggaagactacaaaactctgatgaaggaaataaaagatcaaaataaataaaaggagattccctgttcatcttcaatattgttaatatgtcagttctttccaacttgatctatagattcagtgcaatctctatcaaaatcctagtaagttattttgtaggcttggcaaactgattttaaagtttatttgaaaaggcaaaagacccagaatagtcaagacaatattgaagaagtaaaacaaagtcagaggactgacactacctgactttaagacttactataaagctagagtaatcaagacagcgtgatactggtgaaatgacagaaaaagagatccatggaacagaataggaagcacataaatagacccacgcaaatctagtcaactgatctttaacgcagaagcaaaggcagttcagtggagaaaaggtagtctttttgacaaatggtgctgaaacaaatagacatccatgtgccaagtaaaaagaagggatgaagaaaagaagaagaaaaacagacaaaaatctagatatagattctacacttttccaaaaataaaaataactcaaaattattgtaagtctaaatgtaaaaacctacaaaacttctaggagataatataggagaaaaattttagtaaccttggatttgattatgtgtttttagatacaacaccaaatatatgatccatgagaaaaaattgttgttggactttattaaaatgaaaactgctgctctgtgaaagatactgttaagagaatgaaaagacacgctatagactgggaatatttacaaaacatacatctgctaaaggatatccaaaatatacaaagaatacttaaaattcaacaagaaaacaaacagtaccattaaaaatgagcaaaagagctgaacagacacctcaccaaagaaaatatacagatggcaaatgagcatatgaatgtacacacatcatcccatgtcattctggaattgcaaattaaatgacaatgaaacaccactatataactattggaatagctaaaatccaaaacattaacaacaacaaatgctggcaaagatgtggagaaacagaaagagttaattgctggtgggaatgcaaaatggtacagccactttggagaatcgtttggcagtttcttaaaaagctaaacagtcttaccacgaaattctgcaattgcatgcattccttaatatttacccaaatgagtgtaaaacatgtccacacaaaactctgcacatgtttatgtgatcgtattcatacttgccaaaacttggaagcaacctagatgtcttttaataggtggttcaataaacaaacatccatataatgaaatatcattccacaattttaaaaaatgagctatctagccacaagaagacatggaggaatcttaaatccacattgctacaggaaaggagccagtctaaaagggcttcatactgcatggttccaactacataacactgtggaaaaggcaaagctatagagacagtgaaaagatcagtggttgccaggagttcagggagagaggcagagagaggaacaagtggagcacaggggatttttagggcagtgaaagtattctgtatattctgtatgatactatcatggtggttacatgatattatgcatttgttcaaacccatagaactatacaacaccaaaaggtaaattggggacgttagcaactaatattcaatcaatattggctcatcaatggaatacatttcacaacactaatgcatggtgaataataagaggagaaactgaaaggaaaagtggagataatatatgagagctctgtacttcctgcttaatttttctataaacataaaactgccttaaaaataaaatctattaacttaataatagcatgcatagtctaggtattttttgtagtcaattctattgttacaaagtgggagtggacaaactatacatctctaggcaatctgatgtccaccttttttttttattattatactttaagttctggggtatgtgtgcagaacgtgcaggtttgttacatacgtatacatgtgccataggggtttgctgcacccatcaacctcaacacgtcacctacattacatatttctcctaactctaaccctccccgagccccacaccttgcaacaggccctgctgtgtgatgcccgctgcccccacccccgcccctgctgcgtccatgtgttctcattgttcacctcccacttataagtgagaacacgcggtgtttggttttctgttcttgtgttaatttgccgagaataatggtttccagcttcatccgtgtccctgcaaaggacataactcatctttttttatggctgcatagtattccatggtgtatatgtgccacattttctttttccagtctatcattgatgggcatttgggttggttccaagtctttgctattgtgaatagtgccgccataaacatacgtgtgcatgtgtctttatagtagaatgatttataatcctttgggtatatacccagtaatgggattgctgggtcaaatggtatttctagttctagattgttgaggaatcgccacactgtcttccacaatggttgaactaatttacactcacaccaacagtgtaaaagcattcttatttctccacatcctctccagcatctgctgtttcctgtctttttaatgattgccattctaactggtgtgatgtccacctatttttgtaaataatgttatattggaatacagccacatccatttgtttttgcattgtttatggttccttgggtattacactggcagagttgagtagttgtgggagagcccacgtgtcctagagtttaaagtgttactattcggccttttacagaaaaagtttggcaatccctgttgtatagactctcaagctgaaaagtgtgtttaggagctgtttagttcaattacctaaaaaaaataaaataaaaatgctggaatcctcgcaaccacataattctgggaggaacaattttatagtctaacctctccaacaagtgtgaactttgacacaataatctcaagattattgtaggagaaatcaacttctcttcccttgctattcctgtaacccaccaggcccacaccttctgatctagaaatagcatgtcagagtagaacctggacacggactcatcacttacagccttcattctgaaccagttttgtcactcaaacccaccctgcttctgaacttcttggtactgactttctgctcatgcccctgccaccaactccggcttctaatttttagtttcaataccagatctgggtgccccagctatggcctaagctcctttggatccatttaaatgaaaaatacaatgataggctaaataatgaccttgaaagatattcaggttctaattcctggaaactgtgaatgacaccttatgttatgggctgaattataccccctcccctgcaaaaagaaaatcctcatatgaaattttcagagtcactccctccctgagaatcgcagaatgtgtctgtattcagacatagggcccttaaagaggtaactgagttaaaatgaggtcattaagatgggtcctaatccaatctgactggtgtccttttaagaagaggaaaactggacacattgacagcaggaatgtgcacagacagaggaaagaccaggtgatcacacagagaaaaggcagccatctgcaagccaaggagtgaggcctcggaagaaaccagccccgctaatgtcttgatcttggacttttagcctccaaaactatgaaaaataaatttcttttgcttaacccatccagttggtggcattttgttgtgacagccctagcaagctaatgtatcttatgtggcaaaagggactttgcagaggaacactctactagtctaactttccatctgcattaaatcaaaggtttaaaaatggggagagtatctggattatctgggttggccctaagcgccatcatgtatatccctgtaagtgggaaacagaggaatatctgagtacggaagaggcagaaggtgatgtaaacatggaaggagagactggaatgatgtggccacaagccaaggaatgctgacagctgagtgagacaagtaatggcttttctctgggagcctccagaagaaagccctcctaacaccttgatggtgaccctacaagactcaatttggttgttgcctccagaactgtgagtgaatacatgtgtgttcttttaatcactaagtctgtggtaatttgttacagtagccatgtaaaactaatggatgtgctttttcagataaatattgtttggggcttagtttgatttccaggccctcctcgtccacagccacccaacttttaagcaggcatcagacagccacttaatcactgttctgtccaaatgagagtagcatgcttatttaagctacatttctaggaactccgcagagaacaagctctaggggctcaaacttagtcttaacagatgccagagctcatggtctcaggcctattatagaacctatctaaacctcaatttcctaatcagtaaatgtggatcaaattatcaaccttctaaggttgttgtgacaattttaaatgatataagtaacacaaagaacacattttctggaatacagttattaacattctcaataagtaatattaatgatttctgtcattaattgtttgtggctctccagtaattccaagtctaacagatttccatttcccaaagccacagagagaatttgcaaacccatggcttggggcttagctctggcacctattcagtgaatttgtaccaataaatgtttattctaaaccctacccccaactcccttccactagtcagccttcttctatcagcagctggaaagttagctcaattcggcctccatccctgttacttccctctctcattctttgttatctccagttatctataagatgctccgaataaaacacacacacacacacacacacacacacatacacacacacttggtcatcggtgacttcaattctgctattttgcactaaaggaaactgagtggcttaaattcagaaaggcaaagtgatgtacccaaggtcacagagccaataagtgacaactttgtgaggtttccagggtgctattatgccacactgtgtctcacttgctgggcctgtctctccaaatcctccaccctgaaatagagtgcttccgcctacagctcctgctgaaatgggaaaagtgtttcctgtccacaggccagtcccctctccttccctttttttgaggactcctttcctcagggcagctcctagtgaggaaacagataagaggactccaagcaggtggtgcgaagttgtgagtcgccatgcccttgtgttggagaatgtggcaacacacctaatagtcctccctccctgcaggaaaccaggaaaccagcacttacccggagtgccttcctgctctgtcagcaatccagaccatatggttaattagctaaaatttgcgactgcatctgtgaagctatttttctttttggcatgcgtgaacttaattaccgaagacatgagaagttcctggcccactgggatcacggtgggcatgggtgtcacagaacatgcccatggctcagggtgtgagatatgtgggtggttgagagtttgagaaatgaaggatagagagagttgcttgaccagaggaggatggggtctttcttctggtgttcatgcagacatattagtaaagaatttcatggtgagacacaatgtcacaaggacccccatctgtgtatgtggacaagcatcctcaaaaaatggccaacccccttgcatggtagaatgtagggctcatcgtcttattaccccactgccctgcaaattctatcattagttgctccacagaatatttatcttcccagaacatatgactgtctcccccgcacataggacagggcctgtaacatagaaggtgtccagtaaagatggctgattggcccagtggatgagaccaatcatcttctgagccttcagtttctcatcggcagaaggaagatcataaaaaagttatatgcttaacaaattcttaatttgttaagaattaaatgagatatagtacatagaacacctatcacaggccctgatataatgacaggtgtttgataagaatttgttgaatgaatgaatgaatgaatgagcagccaattcaaacagaaactgaatgccattactagaagaagcctgagagatcaaaatctagtccagtccctccactgtgcctcagtttcctcccctgtaaaatgaggccaataaaatcacttctttattggattgtttgggaatcaaaatagcatgtagaacttttagaagagtgcctggaatgtagtaagaagtcaattaatattgctgctattgttgttgtgaataatagaaaatgggaaaacttattgctagcaaagaaaaaggcctcgcacaaagaatagcagtttgtggtgtgtcctgcattgtaacttggagctccttctttcagttcatactgctacttcctgagcagtatgggcttgccatgccaggagagtgccagggctcacaggacagacatgtgccagctttcaggggtcactggtatgacagaggagacaaattcccctttccctctttggaggacacccaggctaagaagtaaggtccagggttattttggacattattgacagaagaaacttatctatcaggagctctctgatgctcccaaacatagttttgcagattgtgccacagctgagagggcaaatggagactgaaattcatccctgttctgcaagccaagcttagtgcgtatgcagggatgtgtctccttttttcaattcacacataggcactgtattggcagctgtggcctcggagctttctctgggatcaatggacagcttgagggcaggagaacttgaagcccaagaacactggggcaggtgtttcatgggaccagggccattgtctctcatactcatctctgtattcccagggctgcctagtatagtgcttggcttagtggacacaaacacatgttggataaataagccactgtgttccttttattttattttttcttttaaagacaaagtcttgctctgtcacccaggctggagcacagtggtgctatcatggctcactgtaacctcaaacttctgggcccaagcattcctcctgcttgggactacagaagcgtaccgccatgccctgctaattttttaattcctttgtagagacaaggtctccacatgttgcccaggctggtctctaactccctgggctctagctgtcatccccacttcagcctctcagagggctaagattctaggcctgagccaccatggttggcccatggcattcttaatatctatcatagactctaccacttggtatgggcccagtttgtgctggataaatggatgactgaagcattcagaagaaaagtatgtgtgagaaatgatttcctagacctttagccctatagagtaaaagcaaataatttattgaggggcactgagctgtaaacattttctaccttaagtctcaaaacatacataaccgattgttcgcaatttacctatgagggctctgagatttgcctgtggtcatacagctcctaaggagcaataacaatatcagaacctgtgttttgctgctaccagtgcctgttttcacaaccatgctcttctcttctgggtcactgacttggctagtgagaaatataacattccctctgtctgctatactatttctttctgcttgtatactgatgacgcttttacttcattcatgcctctgcttaattgtcacctcctccaagaagcctgacgtgatcactgtgtataaagcaaaactttccaattccttatccttctttatttttctttatatcacttataaccactggaaatacatgtttattttctctctgctgctgccccatccccatctcttcccagaatgttatttccatgagggcaaggaccttaatctctcttgctaactgctattttaccaacatccagaatagtacctgacacataaacctgctcagcacgtatttatgaaatgactgagaggatgactgaaaaaccctgggtcagatagttaaatatccgtttaatgtcagatatgatctttctcttgcaggaccctggtttctttatcagtcagaaaagatacgaagtgccagacctgaggcttccctgtaaatacgggaagggctaacaggacgggtttaggagcttaccaaaaaaataagatatcattattatcattgcaaagcacatgtgcacatactccatggacacagatctttcatcctctccaggtagaacatcccaggtgactgccaaaacttccctgggctgggatgcacaggctagcctcaaagtgccagcttttgccacacccaggagaaaggcctccactaagccaaatcagtgtctcagtgttaagactattttttgaacagagaagtatggggcagcatttgtggcaccaacacttggtggccacataatattgggtgagtcacttgcacaaaaccaaagtaatgataacacccatctttgagggcacttgctagaatcaaatgaactgatcattttacaaacactttctgacatacaaagcttaacactgatgtaagaccctaaccttagacgtgaaagccaggctgagcaattcagacctgactgtgacttgggaacaatgggaggattccgagcgaggaacagacacattaaggcatatctttgggaagcaaacctggtagtgtgtgcaggctgggcctctgctgttggttcctttttttccttctagattgtgcctggggaagggggaggggagagaggtagaatctgcagtgtgggaaatcccactttgactctaccacttgcagaagggagtgggggtggcagggaacagacttgggtgacaggcaccacttgtgccaccctgattaactgggaaaatgcaaatctgcacttccttccccgccgcagctaacaagataatgaatattttcatcagctgcagagaatacaaacatctgtaggaacaccaaacctactctcaagggttgggggaggaggggaggacgcggaggtggggaaacgcagcttctctgcagatttagggaagaggaaatgtgctgagatgctggaaggatggctgggagctggaaatgggcagctctggctggcgcctcccatgcatggtacaacggggaatagctaactgtcctccacccctcatatctgctgttcattcgtggttgtgcatgttgtcactttgtccagcaaccttcaatttattcacctgcacctgcatcgatccctctgcccttccactcatcaagtcactaaacatttgctgattgctattgtgtcccaggcatgaacctaggctctcagagaacacagataaatgagacatcccttgtcctgttgtcttaaagtagctcattcattcacttaatgattaaattcttattaatgaagtacctgctgtgtggtaggtactcacaatcctgttgaaatagacatgggaactggcctactcttgaaggtgctctctgcaagagaagagcgcagagtaggaaggatcactcagcctttcacggaaagaggtgttcaaagaagactcctggaggagttggcggactcctgatgtcaatcaagaatgaatcagagtattttaggcagagaaactagaagagcattccaggtagagggaacagcatgtacaaagtcaagtaggcatgaggaatcccagggaactcagggaactacaagcagctctgtagaaatgggtgatagcaggtaagacaaggggtgggaacagtgacgggagacacttgagagatgggcttgagtccaggtatctggaactgtgtccaccaagataaagaggttagactttatcctgggcacaatgaggaggccctgatgagctctgagcaggggagtgatctaatgagacctgcatgttagacgatcattctggctgctatatggagaatgaattggagtgaattcaggatgaagaagagcaagggagctgttgaggattcctgtcccttatgcaatattcagaaagaattggagagaacactctgtgggtgctggcgaagattcttagatgtggacatgcagctttgccatttaatcaggtctggtctgtggctttgcatagctccctgagagtcagggcctactaataattcctcctttgtggagttttcagtgaagaactaatgagataatttgtgtcaaagtgacctacaaggtctgaggcactgttgaaatattagttatcagttatttaattatagctgtaatattggctctaatcattactttactctttcattcttatagctgatattcagaaatgaaaaatggtaaaaaattggagcctcaaggtcctggttttgccacttgttgtctgtgagcttggaaaatcccctgcatctctgtgcttcagtttccacatctctgaaatggggatgatatttttctctttgtctatcttgcagggcctccaaggagaactaatttggataattgacactgaagtgctttgaaaaacataaatgcttagcaacttgaagtaggtggatgtggactcttatctattgagtacctgtcatgatccccacttttgtagattaggtgttggcaaactattaactgcaggccaaatccagacttctgcctgttttgtatattccatgaattaagaatggtttttacattttttattgcctggaaaaaaattaaaaggtaataatattttgtgtgacatgtgaaaattctataatcttcaaaattcagtgtccataaatgaagttttattggaatgcactcacaacacactgagtaaatgggtggagggatggattggcttccatgcaagagttgtctatggctgttttgccagtgcaacagcaaagctgattacttgcaacaaagatcaggtagctggaaagctcaaaatatttactattgaggccttttcagaaagtttgttcacccctacttcagacatattgacttatttgattgttgcaaccctatgacattgggatttgttatttctctccgtttcacagatgatgaaactgaggctcagagaaattggctcattttcccaaagagatacagaataaaaactacttcaattccatgactactttattccaatgtctgttctctttttactgcaccatgatgctctcataagaggcaaattttcctcctttctgaggacccccaataatcatggcttcagtggctgtcctcctccagactacaaactgtgtgagggtagagattgagacaatcttgtttgtcactgtctatgcaatgtttagcatgtcgtttggcatgcagtaggtgctgaatagtaattctcgctgttttggacacatgtgctaggggtagccacttcattctatcacagtttcccccagcatttatgagcatcagtcttaaatttataaggtatactcattttctcctttcctttttggaagtgagtatcactctgccccctgaatgcagcaatttggagacattagcacaccttctgttcacacaaccactcagcgcccccgaaaaccatcttcaaatacccaaaacttcttctccaggccaaacccatcactcagacttcctgcaaagaggcaagagaatacctatggagggtattctatggagggtgatatgctgggagaaaacacagcctcggtttgtttaaggatgtagagtcagctagacctggatgttcatcctaactcccacaatgattggctgtgtgacatagggtaaggtcttttacctctctgagtttgtttctttgtgggtaaagtggggatgctaaaccccagctgtcagggttacagagaggactgaataggatgataggtggagaatttgcattccagcattgggttaatagtagatacccagtaagctctcctatggtttcttttttctgcaacatgcaaagcactgagctaggccattgcaggtgggtctctgcgagagggtgagggagagaaacaaccagataactccagtaccagcagggtaagagtgctgcagaggaagcccagagaaagagaaacaggatgtagctttcactgagcatcccttgggggccaaatattctgaacacatcactcacagaacctctgagtctttccaacactcctatgatataaggtgcatttttttcacctcatggataagagagctgaccagagaaatcacatgtctgggccaaggtcatacagctagtgtggcagaggctgtgatgctccggccaggttcccttcaagcggggactggtcccagatgctgcctgtgtcgctagcatgcagtctttagctgtcagcccttatggggactgcctcggcctcacctaaggtcctgcccctgctcggtatgacccacaaccatgactggttattgcaggagtatcaagatctaaatgtcttagcccagtttgagccaatgctgaagggcctctttagtcctgagctccctatggggttggctgaagttgtcattgagcctgtagggcagctgaacttcttctccctggtcctccttctgccctgtcccttccaaggtgtcaataccaaagccactccttaaaaaacattctgcttgttgaactcagattctgttttcttagcaaacccagtttgcaatgacagttactcagtgatgaaactaacaattgaaccacatctatttatttctccatttaacctctttctgtggataacttcattactattaatagataaagtcattcattcatttacttattcaaatatttcctgaatcttccaagaagtgtgatccctttcttaatccctgccttcaaggagtttagagtacaataagcttacattagttgtttctgatataattgtcgtcctacatttatgtgagtgctgacatttgagaactttaactgttcttgttattttaattggaagttgagagcagtataaattttaaaaaataataatggtctaatgcagacatcagtctaatcctcagttcttctgagatgcccccaccgtacctttgtatctgcatgtgcctgcatactcaaccccaccacttctgcttttgtctccattttcctcctcatttaattctgtgtcaatcctctttatctttgagagacgctgtgtgaaatgctgatacctctacaaaatacgtgctaatgacaaatttgaggactgaaacagcatgggctgaattagggtaattcagcccaagagggttccttctgagcagaggccaaattctacctgagagcatcatccgatatggcagagcagcctaatgaacctttccttgcagagaaagccctgttctccttctctctctgcattcatcaaccagacaccctgcagctgagtgcacagacagttcctggccccagagtcgggctaggcaaggtctccaggctattcaaaaccccttccccacagcaataccatctacctccaatctagctagctcagtactttccttaagccaccgcattagggacttgaagtgtaaactagtttgacctttcttaagggtatgtgatattgggtatcaacatttaaatatgcatatctcttgcccaagaggttttgcttctgggatttatcctaagaagacaagcagacaagtgtgcacagctgtatttacaaggatgcttactgcaacatagtttacgatagtcaaaagctggaaacaatctaaatatctatcaataggtgattgattaaatgaattataagtctaggtaatagaatactgtacaggcattaaaaaatacggctgatctttaaaaaatagaagggaaaaatctctagggggtattattaagtaaaaaaaaagacaagtgtacactgtaccatccttacatgtttctgtatataacatgtgactgaaagcacagagtgacacttggaaggaagtccactaaaatatgaaggtggtcaccagcatatggaacttcagagttttttaacctgttaatttttagaaatattgcttggattttctacagaaacatatgctaattttattgggggagggaataagcgttgtgtggccttgggcaaataattttctctttcaatactgagtgaaaagggggctactattacctgtcaatataactattaagtattaaaagaaaatgtatctaaggtgtttaaaagagagcctaaaacatggcaagcctccatttatggtcactggtaatagttattataaagatcccgggatagggcagacatcctatacaaatggcctaaaactatgacaaagagacgacaacccccactgggccaaacttgagccctcttacccccatgggtatacacgcacaaatacacacgtgcactgacacacacactcatctcacattcacaaaacaccagttacactcacatacacttaaccacacatggtcacatcacacacattcacactcatgcacacatatacaggcatacattcacatacatgccctcacacaattcacactcatacacacaaacacatacattcacactcacacataaacacacacattcatactcacacaaactcagtcacatcacacacacaagcacacacattcacagtaacatacacataaatgcacacacactcacatacacaaacacatgcattcatactaatcacatgcattcatactcatacacctaaacagtcacatcacacacaagcatacatatttacagtcagatacccgtaaatgcacccacattcgcactcacatacacaaatacacacattcacactcacacattcatagtcatacacttaaacagtcatatcacacacacaagctcacacattcagtcacatacacataaacgcacatacattcatattcatatacatctaaacacacacacattcatacacatatgcttgaacacacagtcacctcacacacaaacacatatcttcatactcacacataaacacacacattcacactcacatacacttaaacacacacattcatacttacacataaacacacacattcatacttatacacctaaacacagtaacatcacacacagaagcacacagattgatagtcacacaaacacacacattcacactcacacataaacacacacaatcatactcacatacttaaaacagttgcatcacacacacataaacacatacattcatgctcacatacagttatgcatacccagaaatacacatataagaacacacaatcctacatatacacacacacacacacacaggtgtgcatgtttagaagatggagagaatgaggcctgaagaattgactcaatgggaacccgccccttccctgcctgccaacctactcacaccctaggtaccctccacacaggctccagctgctttttgctggctcccagagcttatctccctatgagaggagggaggggtggcttgggagagacgagggtgattgttcaggtttaattaagcatgccacccagagacaggcttggcggatgcactgtaagacacattccgctgaactcagaacctctgttctctaggcgtatgcaggcctgacaaaacatttcaaagcagaggagaacattaggaacggagggagctgacagctcctaatagcacagtaacaaggagacactaataaagcgtgtggctgtgagctgagcagctccagagacagacggagactacaggccttcttcaaaggcatgttggccatgcatggaccttgcttttggtgacttctgtcctccacacatcacagaacagggatataacctcttggtgtactatgctcagaaccctcgtgagcaggggtccctgcagccagaactagcagatccatccttgctgagagccctcttaacaatgatggggaacagaggaatggagcaatgtggtaaatatctccagaaggaaggaaaacagggagggagagaaggaagaaagtcctccatttcctaatggcatatctatggtaaaaaagtactaattacttccataagcaacccatgcaactattcatagatctagttatcttttcaagacaaatgttactaaacacctactttgtgccaaactctatgcattgaagatgaaaacaaaacaaaacaaatcagaaaaataaaaaagaccttgtcttcaagcacttagcagtctagtagggaagtcatacaagtaaaaaagacaattagaatatattgtaaactcccaaatccaatgctctctctccactttcttgttaaattcttctttgaaaaagagttatgtcactgattccaatttctcaccactcatcctcactcaacccattcctatctgctttttgccatatttattccacatatcccaccttaccgtggttattgatgacctccaatttgccaaaactgctggtctccatctttctcttactcttaggtgacctctgagtagcctatgacacagaggaccaaactctccttaagaagcatgttctcctggagatcctgtgacttcccagcatctggtgtttctctgcctccctgacccgtcctccatcactggctgactttttgttttcttgtctccatttccaaataatctttctgagctctttttctacctacatttcccctagacaattgctatggtctgaatatttctgtccctgatgaattaatctgttgaaattctaatggccaagatcatggtattagaaggtgaggcctttgggaagtgattaaatcatgagggtggaaccctcctaaatgggtttagtgccctgagagacccgcttgcctcttccaccatttgaggatacagcaagaaggcactgtctgtgagctagaaagtgggctctcaacagacagcaaatctgccttgattttggacttcccaccctccaggactataagaaataaatttatgttgtttatagattatccagtttatgatattttgtatgggagcacaaatgaattaagaagacaatctcatctaaaatattttaaaatcatctatgctctggtgactactaaatgggtaagtttgggactcaactgtgaggtgtatttgcccatcaaatgaaattattatgaccagttggatataccttactttactataaagaaagacccaggctggagatacagatttcaaaaacaacatacatgggatgctctgaaagtctgtagcccagagaaagtgtgtggggagagaagacaaaaatactaagcctaaagccccaagaaggctgggaagtatctaaagaggcaaaagaaaaccagaagtgtactatacagagaagtcagggaatgagttttcaaatgagtaaacaatggtgctaaataaaagagttgggatgaactgaaaactgaatcacatctattggatataaccataaattggtgcacttttggccttgggagaagcagtgactgtgagtgatgagtgtagaaggcagactgtggtgggcgggagagtaagtgggaagtgaggaagtggagaccatttgcatagatttctctttctagaaggctggctgtgaatggaagacataaggtggtagctaaaggcaaatgaggaggggatgagtttggagagacaaacacttatgggctgaaggaaaagaacaggagagaggaagatacttaagtcaaaagaagaagttattaatgacattgtattccttaaaagattggagaggatggggtaagtattaggcaggagaagaaacacctgttcccctaaggcaggaagagatgcaagaatatatgtgtatgtggcacaaaagaagaaagtctgaaagttatgctctttcttgcctgatgatctcacttgtattttgtctttaaaatagtggatgaagctgggcacagtggctcatgcctataatcccaacacgttgcaaggtcgaggcaggagaatcacttcaggtcaggagttcaagaccatgctgggcaacatagcaagaccccatctgtacaaaattaaatatatatatatgggcatggtggtggggtgcctttaatttcagctacttgggaggctgaagaaggagtttgagtttggtgagtaataattgtgccactgcactccaacctgggaaacacagcaagaccttgtctaaattaattaattaataaatagtgaatgacataagaatactgaggttaaattgggggcataaacaagggctctgagagttaaaaaaaaaaaaaaaactaaaaagctaccgcaaggatagagaaaaggaggagatcaacaagagaacttccaactagtgtcaaagacccagccgatattggagaacatagatgggggttggtgcccatttgcactaggtgtggattatgccaactgcagatggctattcccaaggttgtaggaaagatagttgattttttttattcagatctaggggtctataccagaccagtcctttcctcacctacatcttctacaggacaatgattatagcaacagcagctaccagttgctgagtgcgggttatgtgccaggtgccttatatacaatatttttaattcttagaatagtgctgaaaaactatttccccttcatcctgagaaacccaggtcccagaaaggtgacatagttgatccaaggtttcatgagcctgtctgactccagatccctggctctttctctataccttgtcacaacctttgaggcttgacatcagctgtcatttcctttctgagcatttgcttctccaagataaacagttccaggctttgaacaccttcttatggaagcttctttccagtactctcctgttttccttcccaaattgttagtttcctgttcttgaacacacatgtatttacatatgtttttttcaaggtgatgagtaccctacggaaaagccaagactcctcaataaaaagttcttgagaaggactctcttgagggttttccccaagggcaccttcacatgttttaatctagtctcctacctaaaccaatgtgctaattaagatgctctctgaggagccaagaaagtagaacctgccattatatggagcttcaccacctctctggctccccttgcaaaaattgatcctgtgctccagaaagaccaaaccatttactgtcttatgtattttctgtcatgttttctgctttattcatctgctgatctctctgcctaaaatatccattcctttgtccttgcctaacaaccatttacccttcaagattcaactcagacatcatctcttagaaaccttctcaggtagtctggctacatcaggtactccttgcacttcatgcttcctctatcatcacacaggacttgtagggcacagtgattaagagaggaagctaatggactcaccagtcagactagacaagacctgctacagggcacttaatgattgtgtcactttacccctccatgttcccatttttcagctgtcagtggaggatagtgaatgtctatctcataggtttgttgtgaagaagaaataaggtgatccacataaagcacatggcacataatcaatggtagttattcttataacatgtatcaaatagtactacatttatgcttatctttctcccaccatcccataagtaccaagagggtaggaacagcatccaatttatggttctactcccagcacctcactcagaatctggcacatagtaggagctcatgaatgaatgaatgaatgaatgaatctaattcatctcagtgtgtactgtctttgggatcacattatctgaaattacctacttaatttccattatatttagagtgaagatgaagggtaagatatatctttttcaattaaagggcaagaggcctctccaagaatagcctgatgacatggagatttatggatcaagtgccaggctctcagcagtccatggacagttggccatgcccaactggaatatggtctctttcatttagaaattgtcaaggccaagaggccaggcagccaggagtgtaggcaggcaagagaacatctagggtacatggagggatgaggactctacatcagtgccaacattccactactactcatgcaaacaacctttcttgctgtttatgactggtggtcaatctgatagctccaggatccatcctgattgcctggcagccatgccattatatttacaaaatatattaaatattctctcttttaaacatcagaatcctaggttcccagcaggactgaaaaagttgataaggaacccaattagagaactgcaaatgcaaagactagatttcaggttgtgatatggtttggctgtgtccccacccaaatctcatcttgaattttagctcccataatccccacatgtcacgggagggacgtggtgggaggtaattgaattatgggggtgggtgtttcccatgctgttcttgtgatagtgagtaagtctcacgagatctgatggttttataatgggcagttcccctgcacacgctctcttgcctgccaccatgtaagacgtgcctttgcttctcctttgccttccaccatgattgtgaggcctccccagccatgtggaattgtgagttcattaaacctctttttctgtataaattacccagcctcaagtatgtatttaatagcagcatgagaacagagtaatactggtggtcagaagctaagatcaaggaggtggacttcaggtcaggtaaatgccaaccatgtagttgagtcagtgacttagaaatctgagcactgccatgtgaactattccttaaaagactctgtcagccagaggttcactatgggttacaatgatcactgagccccattcccaggacttccctcctcctcaactcccatctccctagctctcttctccttacaccagagccatgtaatttgggccagcagtctcatcttggctgcagtcatcaggacctgattccagtcaaaggaaatatatgaacctccgggtcagagctcagggggcttagctttaggctagcacttgattctcatgtctgttgaaaatacaccaaatggcatagtcattatttctttaggggtgtgtctttcctgctagcctgaggctttcctagaagcagtagaataaaagatggaagagaaaaagaaataaaggaatggaaagcgaagaaactgagctggctcctgcttttcctctctttctagaaaccagttttggacactggacctccatcctatttttttttttttttgaatacctgtcttgatagtctgcccagtgagccatgttcttttatccttgatatttttcttttaggacatagaactctaactctaaatttttgccccttttctggggccattagcctttagcacatgcttgattctcactgcaaagtcctggatcccaactctgagctaacatttacctgccctgcccaagggggtctgtatgaaccttcccaacctgatatcataaagctttttcctctctgaaagtctcttttcataaagtttatattcctgccaaggtcttgaccgagaggtctgtggattctaagaaggaaatgctgtagtcaggtggggaggtcatgagaaagatggggtcacagaaatggtggtagcttaataacaggaaaggcagatggaaccatgcctccttcataagggagaacctcacacaaagatgggctttaaaaagttgcaataaacacagaactcagaattaaggtgagaaagagagaaaaagaaaacatgctctgaatataccacatactgagcaacacgaaattattaatacacatattatctcatttcatgttcccatcttcccttgcagtaagagccattatcctcattttcacagatgaggaaactctggctcagagaggttaagaatcttgttcaatatcatcaagcaagtgagggatagaaaacccaggattgaatctgctttgtctgattgtaaagacttttttttccctcctacagatacagatatttagcctagattggaccacccatgcacttctaaggcatacattgttcccaaattagccctacatccccatgatacctatctttcatagtttaagagagaggttactgtcttctcttattgtctggctctgtccatcaggaagttgtagaatcataggatataaaaactgtaagtacatgagtggtctgttggaacagtggtttgtacatttatttgtagcagaattcatgtttggaattcctatacatgaaactgacattgcatgcagcagactcctcagtattcatctgtatctctctggaagggactcttcaggctcttctaaagaccactgcccctccaagaaacacagtctgatgtactctcaccctcattttctcatttgtacatgaggactctggagatcagggtcaagaagggcttgcccaaggttactcaatggaagaacaaggacaagaatctgtatctcgtgctttctattctacacagtggccaagaaatattcatcagggtaaaggaaaaggtatcctggatccatgaaagtaagctatttgggagtgggttgaagatagaagctttcttctggtggaaaataataataatagcacccaacatttattatataccttctgtggtgctaggtacaatgctaggagctttttttgcattattccatttaatcctcttatcagattaggatcccattatgcagataaggaagctaagccttaattcttcagcactaggtgacccagttggtaaatagctttggtggatttgatccctggccatcttgctcgagagcctggctcttagtctgctctactgtcttcctaggaacaggaataataatccagtgaaggctagaagcttgttcatatttaccaacatatccttccctgtcctcctgctaatctcccagcaaatgctctgcaccatcagacatctcattttcctcaccatgactgctaatatgcagggccttcggtataaatgtacaccctctacccagcctccagcaaactcacatgcacccatctacacacatgggcacatgctcatgcataatgcatgggaccaccatcttaaatcctgctaaattgagattcagctagctgtttggtctggagacacctcagtgcctgcgtcattagctgagctctgaaagccatcattactgcagccactgtggctgagtcactgagaccatgagcaggtaatagaatttcagggacacataataaaagggaatggaatgggattcaggtcggaaaagactatctgttatccagtcctgaagggtggatatgtaaacaaggagctccaggcccccaggatggcgattccactgagtccctcagcagaggataataaaaggcccaattacaacctccacactctgagatttcaaaggaaaggaagaaaaaaaatcaatgaaattaatttaatgtggacccattctttatgtttgctttgctagagtagttgtatgagatacctctatagaccagcccatcttttctcacacagtgactttatccacaagaaaggaaggaaggaagaaaggagagagggagagagggagggaggagaggagaagagaggagaggagagagggaggcagatggggaagaagggagggaagaagggaggaaaagaggaaggaaggaaggaaaagaaagggggcaggggaggggaggggaggggatggaagggagggaagggaggaggaagtaagggagggagggagggagggaaagaaggaaggaaggaaggaaggaaggaaggaaaaaggacaggaagggaagggaaggagggtgagagggagggagggagggagaaaggagggaaagaaggaaggaaagaaggaaggaaggaaggaaggggaagggaggaaggaaggagggagggaggaggaaagggggaaggagggaaggaggagggaaggaggagggaaggaagaaaggaaggaagaaaggaaggaaggcaggcaggcaggcaggcaggcaggcaagccaagccttcagacatatttgtttctgacatctcaaaggaggacaaatcagggaatccaaggttggaagagacattcaaatctcatttttcatggcataaaggaaaaggcagcatctctacgtatgattgtgcagcttgtgccctgcataagggtgccccactgaagggagactgggtattgaggtccagtccatggtctaaatggacaagcactaatccttgcatggcttgcatctatacatgtataataagcaggaaggatccaaaggtagagctagctcttctcactaaacaggcaatcagagatctgcattctgtggggtttgtattctatgtgatcttttatgtgtctgctttctagatatattccctcttttgtaaaggaagggttttaggtaaggtacagggtgaggggactatcattaatagagtatggaattcccaccaagcatagtgctgagtataaagcatttgtcttaatcttttcaataatccctttttaggttaattagtcccattttacagatgtaaaaaagcaaggctcagagagttgtgatgggttacctgcctgcaggtcacaaaacacctgagcagagaagccagaattgcaatccaagtgtccgcgcttgaaacctatactcttccctgactatatgcctcctctctaaggctgtttccgctccttgttttctgtgattctatatgtaaaatggccttggttattgaggttttgggggtttgggataagggtggagggcagaggaatatgttgctaccaagtcaagcaacagagaacaacctgacaagagttaatgggtttgtgtaggggaggcaggagcttggagagtgctggcaatgagactgaccaaaaacagaactggtccttctaggaagctaatgagtaagtaatcctgaaaatcactgtccagtaagcctggtgtcaatattgagtaaaataattggacgaatgtgcccagagataatctgtaagcattggaaaaataatggaatagtgagcgataagggacaccagaggttcatgcagaacaaatcattctagacaacttgatagcttttcctgacaaaattacaaaattagtggatgaaggagacatcgtaaaggttctggattttgagctctaacaaaaaattgaatagcatttcttgggatgcctatcttgccaagttaattcaaactgcccctgattcaagctgtgctgtgtgaatttgtgttgttaccaaatctggttggacaatggagccaataggtgctgatgcatggtactgctccaagggtaagggccagagactctcacccctctctctggtctggaaaagaatgtgacagaagggctactgagacccagacaagaaatgcagacatccatacagcagggaaagaccctggggcaccagggggaaggtacattttttagataatttgataatcatatccttcctatggggcaggtgtcatcatctcaccctctgctccattattcacggtcctcgtaattttgcttataaggaactgaaggtcagagtgggagtggcttatcacacagataatgagttgcggcacctaggttgtaacccaggtgtgtctgattccaagaattggtatactctcttctctgaccagtggttctcaagcatcagtttacatcaaaatcacagagagtagacgtggcatgtgaggcggggtgggagacagttgttaaatcactgattactgggacccacccctagggtttctgactccgagggtctggagtggtgactgagaatttgcatttcaccaaactcccaggtgatgctgatgttccaatctaagaccacacctccagaaacactctattccagttccgctcagatattaatgtgcaaataactcacctgaaaatctttttaaaatgcagattctaatttagtgaagttcctgggaaatgaagcaaattgcattactttctcttttttttgttttttgttttgttttgtttttgacatggagtctgttgtcaggctggagtacagtggtgcagtctcggctcactgcaacctccacctcccgggttcaagcaattctcccgcctcagcctcccgagcagctgggactataggtgtgtgccaccacacccagctaatttttatttttatttttagtagagacggggtttcaccatattggccaggctggtcttgaacttctgacctcgtgatctacccaccttggcctcccaaagtgctgggagtaccatgcctggcctgtaaattgcatttctaataagctcccaagtgacgtctatgctgtgggatgttaccacacccaagaagcaaacacttatgccatgatgttgggaaatgagaaatctagaaagatagcactacagttcaagaactgactctggaatccaaaagtagagaaaacagacattataccaaaaaaaatgagctgcaggaaggacataatttggaagatctgagttcaaaatttggtcatgtctttactagctttacaattaggggatttttatttattttattactattatttttacttctttaggtatcagtgtgcttattatttgaggatcaattactaaaaaaaattaaaaagaccatagggaaaatacttgggggcttctcaaaatgattgctgaagataccctccatggtattgctcaacatttcttgtgaggaaagccatgaataaaactgttctcaggatgcagtgctaattagtctctccttcccctgatgactagctatagctccttccacttgcacaaggaacccagtgcacccatccttgtcaaaattttactcgactcagcaccatttatagctgctttattaactcagaattctagaataaaacttgttctaaaaataaagtatacccctctgcattaaatacctcactatatatatgcaatttatcgccacctgtctgaagtcctttaggagaacagagggggcccgaatctaaatgattgattaagtgaatgccaatggaaggagtgtaggctcctcttgagacatctgtgaaactcaagagggagaaatcaaagaggaactatcgcatactgttaggtacagtcagaatgtaatggctaattactattatgattgtgattattatacagtaaaaagcaattacactttaaacttgatgtttaagaaacctgtaacaaatacaactctaccccatgtaattttccaaactcaatcaattcctaccactctccccatatctctgtgtgccctcctgttatggtctgtccccaaaactcatgtgttgcaaatttaatccccattgcaacagtgttgcagggtggggtcttttggtaggtgtttgggtcataaaggctccactctcattaataaattcaagcctttataagagagcttaacagagggggtttggtcccttttttccccttctgtcccttttgccaggtgaggacacagcatccctttcttccagagaacacagcaacaaggcaccatctcagaaaagagaccaagcccctcaccagacactgaacctacctgtgcttttattttggacttcccagcctccaggagcatgaaaaaataaatatctattctttataaattacccagtctcagatattttttttttttatagcaacacagacacctccctacatcacctgtttcctggagcattccctgacctttcacctttgagttcccccgacagggcctatctaccacaaagaaaattctaaacattgacttatttcttaaggttcctcaaactccaggaaagtcttctctagtattgctaatttcccttctttttctgttcattttctcagagtaacataaatttccccaaagccatgtgttgtgtatggctctccatggccaatatcaggtcaaggctccttccatgtccacctgggtcaataattaatttattcattcatctccattttcattcattttttaaattcccccctggtctcagcctttccttcaactatttcaccactcattaatcacttcactaatccattcatagaatcaatcatttacacacttattatctacatattaattatatattcatgtttatgtatcaatctgctgagtagtttatttgattttcattcacacatcaattctctcatcacacattcattcactcacccactcattcattcattgaacaactacaacagtcactgggtgctcactctgtcagaatctaacttgagtactgattctagaagatataatctctgctcttgagaaattcacaaaccagccaagaggacaaagaagcaaacggtagaataccaaattctgtgtggccagggtggagcagaagagaacaggaggttgaaaagaaaaataagtaataataactgcacacctactgtgtgctcactgcttcatatgcattatctgatttaaatgcacctttctctttaataggtaatgaaaccaaatttgctcactgaatggacttagctgaaatctaagtctaggcgttctcattctgctccccatgctcttaaccactctgctgtattcaccgtaatataatcagcgaccttggtttaggattagcatttctggggaacagtgtgggagcaatcaaatttgaaaggtgtgagaagcaattggaaagtgaggaagtgaagacagtaagtttctatcacgcagtttgtccttccaggggagaagagagaaggctgtaactgaagggggcttaggattgagcaccagacagcagaagaacctcatgaccctgggcaagcgtatctatcatagtagctttcctcattcttttccgttagttctcttcatttccatttccccctacacaaccaagagctattttatttacttttgtatatactaggacttagaatagggcctgtcatagcatagttgataaattaatatacatgaatgagtgaatgaatgaatgaatgtcaaattctttttttttttttgagatggtgttttgctcttgttacccaggctggagtgcaatggcgcgatcttggctcactgcaacttccgcctcctgggttcaagtgattctcctgcctcagcctcccaagtagctgggattacaggcatgtgccaccccgcctggctaatttttgtatttttagtagagacggggtttctccatgttggtcaggctggtctcgaactcctgacctcaggtgatccgcccacctcggcctcccaaagtgttgggattacatgagccaccctgcctggccatgtcaaattctttaaaatggattcacacattgcctagagttctattttgcagaaaggagggagaagtaggtcagctgactggagctttctacaaaacagcccatggaacaggccttgtcttggaaagatggtgatgcagacagagtgactatgataaccaaaaaataaactaaatcaacattgacaaggaaaatgtaaattcagaaacagggaaaaactgaattcaagcgctagtggtggacaggaccaaagttgaggacacaagtaggcatataggatgttcttaaagcagacaggaaattggccctagaaaactcagacctggggggcaaatgtcacatgcctatatcatttggatgtttgcacaatttcctggcaatttgtgtcggtccacaagcccagcagagaaaagtcttacgggtgtggagaaaatgaaggttttagcttcagtggggtgggtttaattagaactgttattagtctgttgtgcaaaaagctcattagaaactcactggggctctcaaaagtgttggacatttttttataattacatttcttctgattcctccatgggtttcttgatgcagtctgagcattggatctattaaaggtgtgtagggaagaatgacttccggttaacttgtcatttcagtccagggccagatacctgcagttcttgccccacatattgttgaaaagaagaaaggaatctgaaagctggtgaactgtagcaggttctttgacatgtgttattttatatcacaacaagcagaggaactggatgttcagatacctcgagcagctttcacaaatttacacagctagttagtggcagcatcagcattcaaaccccagttggtctaactccaaaacccatactctttccagagccccatgctgcctccgacagtgagacttcttttgtaagagaaaagatttctcacttcagtttggcaactacagtttggggaagggagagaaagtgtgggcagggtagcaaagggagagaggaaaaaatcataccatgccagtttcagactcaaagatcactctctagctgtcagtggagcccacaatcactgtggagttttattaaaaagcaagagttgtagaagaatgaagcgacagatttaaaattaacttgccaaactccccatcaatattatgacagtccccaagtaccagttcagcgacccagtgcaccaacttgacaatattaacataactttgttggaacaaaagcttctcgaactctgtcttttcaagtgaagctaattttgaggagacagccattcttctttctgccttttttggcacctctgtgacaggtccccctggcccaacctaagagtgcatgttttataaacttctattatcctttcacctccctggggactgccacccactctggatgcttaagtcaagtagagcagtacttcttccacttagggacgtactgaatgaatgaaggctgggaaagagatctgcatacttgccactttctgaacactgacttgggttccctttggtctttatatttggaatgaagatccgtgatggctaacccaaccaaaattcacatttagggcaatgtgctctctgtaccagcttttataagctaactgcagtctgattccctctttttcttcacctaacaatctcttacttacccttcacatctcagcttagacattaatttcatctacctggagtcctacaccccatgtgggcttgccctggtagcactctgactttcatacctaacactgcacgggtcagtttatcgaatttcactcactaagtatctttcttttgttagtgtatgagttcagtaggtagagtgactacataatttatcatgtgatccaggggacttttgtctaggatatacgctaaactggagaggactttggacaacagtcaaactagactgtcctagtaaaactaggatatatgagcaccctccacagatgggcatatatcgcaactgtcaggctttctgcgtctctatcacctcgaacagtggttaaaattttagtcagtgtagcatattttttgaatgaatgaatgtataaaacagttccttttttttttaaacaagtctcacaggcaaactcataaaatctttccttccttccttccttccttccttccttccttcctccctccctccctccctctctccctctatctctctttccctccctccctccctctctctctccttgtcattcttccctcctttcaaccttctatcttgttaacgacctaccacgcaccaagccctgttcactctaattactgggcatacaaataaacatggctctgtcttgggagtgagaaggagaaacaattagcatgtagtgagcatctactatgcatctgttgctttaaacattgtatattattaatatatatccaactattcagtgaggtagttaatatgttcacctagacaatgaagcatagagacaggtcaggtgacttggccaaggtcacacagctaatagcagcagaggttgaattcaatttcaggtctgccagagtacaaagctgtggtctcatctctaaactaagctactgcctaaactgtgtagaaggaaggcgaaatatagggcagtacagggtgtaaagagctatgggctgaggaggttcctaatacatgagcacagaagcttctctaacccacaaaatcttatgctctttatcgatggacataagaaaaatccatctctaacttacagctaccatttgttgagaacttagttgtatagatactttgctaggtcttggaaatttataataatgaagagtcaagagtcaagttaagcaggggaggtaaatatcaaataataatacaaatattaattttatttttcacaggtatttcagagaaaaaaatagtatgaggaccatatagtatgagacacagtattttttaatcactattttcacagataagaaaaatgaagcttgaatggataaatggatcaagactgcactctacagagctaggatttgaacccacatctacttagctccgaagtctgtattgtgtttacttccccacttttctcctgaacaattcaatcataacacccctaatgaaacagagcaaatccttcaccactacttttcatgctctttaaacctcaaagtttttacatgcagaacagatataacactggctcttctctgtaagcttgttgtggcaattaaagaaaagacagcacttgaagcaccttgcagagtgcctggtccacagacatgttcagtaaatagcaaatattgtcatcattaatattattagacagtattgaattattgactaaggtcatgtggtgctccatcacacacgcaatgtcctgtgttgttagttaactttaacatgggcatgttttcatggcattctcccattcccctattgtccccacctttgagtccctcagcctagcactgtgatatgaatggagcagaatgtgtgaccaaccaagtgttaaaagaggagagaggctgtgttggggggctcatgcctgtaatcccagcactttgggaagttgaggtgggtgaatcacctgaagttgggagttcgagaccagcctgaccaacatggagaaaccctgtctctactgaaaatacaaaagtagacaggcgtggtgccgcatgcctgtgatcccagttactcgggaggctgaagcaggagaatcacttgaaccagggaggtggaggttgcggtgagctgagattgcaccattgcactccagcctgggcaacaagagtgaaactccgcctcaaaaaaaaaaaaaaaaaaaaataagaggagcaagaaatggatatttgaatatggatttggagccagactgtctggattccaatcctgtctccatcctttaccagccaaatgacaatgagaaaattattcagtctcttaacaattcagtgtcatcatctgttaaaaaataagggaggggaaaaggttgacagctcctctaggtgtctgtagaactgaatgcgtttggacagtgaagctgctgcctgggtctcttcttgtgtcactgggagctcatcctcagtctcctttgctggtggctcttcacctctccgatgttaaactgcaggactcagggctcaggctcctctcttctctatctactccctagtgagtttgtgtcctctcatttcttttctgtcatctacatgctaaataatctgaaatgtacatttcaagtcatgtttctcttctgaactggtatatcctactggcttcctgacatcaccataagaatatatattagacatggccagatgatggctattgacgccggatgatgagtgcctggggttccatcacactatggtctacttgtataaatgattgcaatgtttcacaatcaagttcatcttttaacattatcaaaaacaaatttctctttctattcccctcccttgtgcctgctcctcctgtgggctttcctgtctccatcaatggcacatccgtctgtccaactgctcaggcaaaattcagggcactaaccttgcctccctcctttctctccctcatcagtaaatctagttgtcccaccttcagaatacatacagaatctgcccacctctctccatgctgacttgtctgaacatgctccaatccacagtcgtctgacatctggaccacagaagtagcctgggaactgctttccctgatttcaccctgcccactaacgtctattcttcacaccccagtcagattatagaccttttctgctcaaataatgcactagcttggtttccttctcactcagagtaaaattcaagctactgcatttaggagtcccacaggaccctatacaaaatggcccatacttccccagttggtacccattgcctctttatttgtaaccttttttcctactacttgccccgcctccttcccctctgttctatccaccgaggctccttttggtccacagaaaatgccaagggtctttgaactcggtgtgccttctacctggaagctgttccccagatatgtgcatagttcactgccttgtttcagatctttatacaaacgtcaccttgtcaagtaagtcttccagcctgtaaaacatagaatcccctgcctaaaaccctctagtacccttaactcaacctgcttttctccacagtgtatgtacctgacagggtgtatatttatttgttgattgtcccctacactagaatataaaccttcagagcaggggtttttatatattttgttcactattgtcttcctggtttcctagaacagtcagtgtcatagaataagtgctcaaaaaatatttttgatagagtgaagatacaatagtgtctggtgcagtgtgtcattgttatctggttactcttattactacaatcactactgttacttgttactcttgttactacaatcactactacctaaatactggagagatacccaagaaactaataaaaatgggggataggggaaaaggatagaaaaaaaactgagaaaggagtgacattcctcattgaatgtcttttatactgtttgtgtttttaaactttgtaactttaatgcctgtaaagaaatcagtttaaaaatatgctgatatggtttggctgtgtccccactgaaatctcatcttgaattgtggttcccattatctccatgggtcctgggagagaccaggtgaagataattgagtcatgggtcctgggagagaccaggtgaagataattgagtcatgggggccatttcccccatcctgttctcataatagtcagtcagttctaaagagagctggtggttttaaaaggggcttcccctttcactggacactcattctctttcctgctgccctgtgaagacgtagcttccgccatgactgtaagtttcttaaggcctccccagccatggggaactgtgagtccattaaacctctttcctttacaaaatacccagtcttgggtatgtccttacagtagcatgagaatgaactaatacatatgcctaccaaactgtcgcagccaagcggagctaaggagatggacaactcagtgtgagatggtgaccaagatgctcttaagcttcccatcagcttgactaaacaccaggcaggcttctccagtctctagatccctgacctgccttttcttaaagcatttactttagaaacttgcaattgtaaattctttctctgcccctttaagacataaatcttttataaagtttcttgccagttttacaatctaggactgtctttctcaaggacgtgggagctatttctttgaaatgtaatcatcaaggaagacagtacccctatctcttagtctttgtggaagggtggaagcccaacttccatggacaccaattagcaaacacagatggcctaatcacagagaaatacatttgcaaagtcaagaataactcaatgtgctggacatatcctattgttcaatctcctaatgtcctccagtacttttccacttactccagcaattaaaaaccctcctgtccttttcagtttcagtgaaattgagttcagacctctctccttcctctattgcaatagccttgaataaagtctttcttgcctgtttaacatcatccagtgtcattttgctttgatgtctgtatgctgaatgggctcctgtatcagaaaaaggacatcagataaaaactaaggaaatctgaataaagtatgaactttaggtaataataatgtatcaatattgatttattaattataacaaatgtaccataaaaatataagaggatgctatgggaaactgattgcagggtatatggaaactctctgtactatctttgtggtttatctataaatctaaaactgtttaaaataaaaaaatatatttttaaaatcctatctgaacctggaggacatcatgctaagtgaaataagccaaacacagaaagacaaatactgcatgttctcacttgtatgtggaatctaaaaagtcaaactcgtattagagagtagaatggtggttatcagaggcagggggtgggaagaagatgaggaattgcggggagatgaagaatagggagagattggtcaaagggtacaatgtttcgattagacaggaggagcaagttttagtccattgctcagtgtggtgaccatcgttaataatggattatatatttcaaaaatttgctttgaaaagttttttaatattctcatcacaaaaagtatgtgagatgatgaacatgtttattagcttgatttaatcattccacagtgagcacatatgtcaaaacatcacattctatctcataaatatatagaagtagtatttgtacattaaaatatatattaaaaataaccctatctgagtggaatacggaaaagaacatccaagtgtcagaaagatccagtaagtaaggctctgacaccagctatgtgatgacagtcaagtcatcagatctctttgagacccagttacctcatttataaaatgacacttgcaaatccactaacatcatgcattctcagtagtcgcagaaattgtcttagacaatacaatggcttgtggtcctccaatgtctaactctacccaataaaactgtgacccttagtatttaatttctctcattaagaagaattcaatcctattttttttctatgacaaggggtgacagtaaaaaacaagtttgaacacagccttagataatacaaaaaataaaaaagtatattactttccctttacaccaacattagaccgagttttgttcagcctgaatccccagaacctgtcacataataagctcttgatgtgtactgattggctggagcacaaagctgaagcaaatttaattgcaatttagcttaattctcaagctgtgtttccaccttctttgcaaatacagctgcaaaatgcctatatggtctctgggcttgtttattcccagtggctgggtcctcactaactcctaagaagtagggaattaatcgaaacttacagggatatcctttagagcaactttagttctctgaaccacggcatgacaagtaagaacaatcacttcatcgtctttctttcctcctacactagaaagcatcaaaaagaaagggaagcagcctcaaggtcactgggaactcagtaaagaatgaagaggctgactcagggtttaaggttctttcaaagtcctcaggcatacaatgaattaaccagccctgggctactcaaatgcctgtagctttgactcctggcttgtgcctgctaattaactgtccacttaatgggctcctctgaggatctcaggcaacataaaaaaataaatgctcattttggactcttaaaagccacctttgaggtgttccactagattatcattaatagtaattattcagtagtgatgttacataaaaccccagccactgcccttggagctttctgtataaattcacatccaataaactgtgatcatatctttcattagaactgttactacatacatttcaattcagggcatctctttgaaataaaactatttccttaaaagttaattttcttgatacacatgtgtgggcttattaatgtgaccttagaatagacttactgtttcatttatctggaaggaatacaaagaaagtaatgctggcaaatttgcatctcacatgatttcaagtgtgacaggacgcacactacaacacaattttggagtaagtggtatctcacagatccctggattcatgttgaggaaaatgtcactaatactcccacatctttacaaggcatcttaacctgacttttctctttctctttttttttttttttttttttttgagatagagtcttactctgtcacccaggctagagtgcagtggcgtggtcttggctcactgcaacatctgcctccctggttcaagcgattctcctgcctcagcctcccgagtagtttggattacaggcactcacaaccacacccagctaatttttgtgtttttagtaaagactgggtttcaccatgttggccaggctggtcttgaactcctgacctcagatgatctgcctgcctcggcctcccaaagtgctgggattgcaggcgtgagcccccacacccggcctacccttacttttctcatcacctctttctcctcttcataattctcctgtgaggcaggcactgttatgttccctgacttcatggtgagaaaactgaggcttagaaaggcaattagaaggtgcaaggtcttacagctagtaatggccccctttggtgcttacatagcctttcctgttggaatgtccatcctccgccctggcttccttacctctgcaatcccatccctccaccccttcatgacccaccttgactttcacgtctgcagaccctctttgttctcatttgcctggaacactccctcacatgctaactgttactctagcctccaggtctcaggaagcacttcttccagggagtcttcgctgcctctcactgagcaaaatgcacttgatgagtagtccttctgcacaagaatagggacgtcaactgtcttcttctctttatctccagagattttttttttttttttgagatggagtctcactctgtcacccaggctggagtgcagtggtgtgatctcggctcactgcacctctgcctcccaggttcaagcgattctcctgcctcagcctcccgagtagctgggattacaggcatgcgccaccacgctgggctaattcttgtatttttactagagacggggtttcaccatattgaaaagaaaggaaaaagaggaaagaaagaaagagaaagaaaggaaggaatgaaagaaagaaagaaagaaagaaagaaaagaaagaaggaaagaaagaaagaaagaaagaaagaaagaaagaaagaaagaaagaaagaaagaaagaaagaaagaaagaaagaaagaaaagaaaagaaagaaagaaggaaaggtctcaaactcctggcctctagtgatccacctgcctaggcctcccaaagtgctgggattacaggcgtgagccaccgcacccagccctatctccagagatttataagacctgatatataacagatgttcaataaaaactcgttaactcacaaatgagaactagtggtaaagccagggctagaacttctgacctcaagttcatttctgtcatcatcttattccctcttataattaataaaacaataacagtaacaaatgacttctgaggtgtgatttctttcttgagtgagataccaatgtggattgaccataatgtaatacagtaaaatttcagtactgtggactccattaagaatgcataatgccttgaccagcagctgggctggctcataccttagaagtgtttatttataaaagagattgctaagcacattagtgcattagcagtgtaaacaagatcatgggggaaatggcagaagacacttaagagaacaaactgcctggagtcactttggaagcagccattatgaacaaacaatcactgtgctaattacaattgctctgctaattacaattactgtgctaattacaatctaaccttatctgttcataggttccctaaggacttttctttctgagcgtttagaccagcctgagttacggcctgcatttgagtgtaatgaaattgcgcttctttaaaaattgtctctgcttcagatgtctcagtgattcagataggctttccccttctagaaaaagaacacagtcagggattttgaagccagaaatttaaaacaaaaccaaaaaaggggggaaagcgagctgtgaagacaagcaaaatggatcttgttgattttgttgttttagcacctcttgcagtctagagacacatttttaggttagttggagaacatttgaaatatactctgtataatttgttttcttcataaaatgaccaggtttggtatatttagagatgttaacattgagaaaattttaaaaaattaaagtggctatttttctttcctctcttaccataaatacggggaaagattacagagggcttgtttaaaaatggatcccaattccctgctccccattaaaaaaataataataataaagaacatctttcactagatcttaattttactacttactttctatccccagtcaaactaatgggtgttgatgctatgagatttttgtttcagcgcttaagaataataaagcttcacccaggccaatgtcttctcctaaatggatttctcgctactcttccaggagtttgtcttcaacctttgacctgaagcagaatgcagcccagcactctgctggtaagtagctttctgctgcatccaattatggctgaaattgcagcgtgggcacatagaggaggctctaatccaggcacccaaccgtggcttcagcacctgggacttagcagcctgccttcaataagtgccttctctgttggcactgatctctaagcatccctgtgcccatcagatagcagagcggatgaacacaaaataacctttgctacattatgcaccgggggcctattggattgcaggagaggtctgtctcccctggctgctgcaaaactgaaacatattctctgcacttggtcactctagagaggattatacgcagaagacttctttaagattccatggatctctagtgccattggccttgggacttggttcctgctttcaaactggcaaatggaggaacaacaattcttcattctcaggcataacctaggcagctcgtgtttccatctagcatttaagttcagtttaacactttgctattcaaagctgttcctctgtactcatggacataaagatgggaatagcagaaactggggactactgaggggggaaggagaaaggggacaagggttaaaaactgaatattgggtactatgctcagcacatgagtaaagggatcattcattgcccaaacctcaggatcatgcaatatacccaggtaaaaaacctgcacatgtaccccctgaatctcaaagttgaaaaaaaaatttaaaaagagaaacaaacaaaaaataataaaataaaacacacataacaattaacccaatcattctattcctaggaatttgtcctacggatatattagtatgctcagacatatatacataaaattgttcactgaaatacgttttggaaaagccaaaaactggaagcaacctagatgtgcatgaataaaggagtggttaataattatatgattcaatcattcaacacatattcagcaggaacgggggacacagcaatgaacaacacagacagaaatccctgccctcatggagcatatgttatccctacagtggaaaaatatggtatgcctgaaacgtaggaggaagatctataaacattgatagctctccaagagctatgagtaagtgaaaaactcaaggtgcagaacagtatggctggctatctagctagctagatatttagatcatatgatcccacttggaaacacatattttaatttgtttaaaattctggtgaatacaaaaggaacttaacggtcctttgggaaatgggattgaggtccagaaaaaacagaatcttaaatatgtttgaaaaacaaacaaaaaagctggtccttggacccagcagctaatttgaaatacagagcctcagaatttattacctgtggcctactgatgcataatctatattttagcaggcaattggtttgtaccttagagtttgagaagcactggcataattcatgtgtattgagttctgactttaagcagatatatggaaaattcccacctttagatagggttttcatgcataataatgatgagctattatttgcttcccagctcttagaggatcatatggtttggaccaggagtgtccaattttttggcttccctgggccatgttggaagaagaaagaatggttttgagccacacatcaaatacactaacatcaataatagctgatatgcaaaacaaaacaaaacaaaacaaaaataaacaccttttttttttttttttttgagatggggtttcactcttgttgcccaagctggagtgcaatggtgcaatctcggttcaccaaaacctccacctcccaggttcaagtgattctcctgcctcagccttcccgagtagctgggattacaggcaggcgccaccaagcccggctaattttgtatttttagtagagatgggatttctccatgttggtcaggctggtctcgaactcctgacctcaggtgatccacccacttcggcctcccaaagtgctgggattacaggcgtgagccaccgagccgggccaaaaacctcataatatttgaagaaagtctacaaatttgcattaggccacattcaaagccatcctgagccacatatggcttgcaggctgtgggttggatgagcttggtttagaccatgtgcatgtgcctgagcacacatgttatctagaggccatggagtgtttagaagagcagcccttcaatcctggctccattatttacacgctgtgtggccttgaatgccatgcttcctctctctgggcttcaattttctcatgtaaagcgtatgagcatcaatctgctttgtcaacatgtgtcatgggagaaatatctgcctatgcccctcaaacacaggctttgaaagggatagaaaacagttttacaagatgggttatgctttaagggtattgggaaatgaacagaggatgtgatgtggtgataataggggaagaaaattaggacaggtagtaggtgagcgagactgatgtgcagtccagcaaggcttgctggttaagctttatgctgtttgaaagggcctcctttcctattgggcaagtggcacttctatgcttatcgttaaatgtttttgtttttgtttttttgtttgcttggttttttcagatggagtttcactcttgttgcccaggctagagtgcaatggtgcaatctcggcttactgcaatctccgcctcctgggttcaagtgattctctggcctcagcctcccatgtagctgggattacaggcacctgtcaccacacccagctcattttttttgtatttttaatagagacgtggtttcaccatgttggccaggctggtctcgaactcctgacctcgtgatccacccgcctcggcttcccaaagtgctgggattacaggcgtgagccactgcacccggccttatcagtaaatatttttaatatcaccctagaggtgggagattagcacaccactgcaacttttggatctgggcccaggccctttatcaaattccacatagtaaatatgaacacttaaatcccacattcctaataagatgtgtttcattacagaatgttcagacagaaaaaaaaggatgtccctataagggacaggtgacagaacacactggagagattatgttttcccgaggctgtgattccacactgctagctgagctgtccacttcccatgaccctcacccccagagcatgaagggctgagcttctgcccctatcctgggcatttgatgaaagcaccatgtttaccaaaacatgagctgcttagaagaagttgagaggataaccctggctccagtccagaaataagttttgcagggaatgaaaaaaaacccatcttcatctgctgtatggctcctggaactggggggaaaggaatgcaatttaaggcagagaaaggaatggttattgggatcctactgtgtgctgggagctttgcttatttgcctgttaaatccttgccaaagctcttcagggttattttaaggtaaaacaccactttatagttgaagatcttgagattactgaagttaagaaatttatccaaagccacacagcttggaaagggcagacacgggatttggaccctgttagtttttaacagcagcacaccagccaggaagaggatctagtccctgcataatcctgcacatgcaagtgagctttgcttacagctcctccttagtgatgaacctggcagccctctatggcacgtgggacttctgtctgccaaggacagatatgaaacaggttccaattccatttaattatctcaacaccaggaagtgggcattgttactattattcttaatttagggatgggggaaattgaggcttaatgaaataatgtgtctatagtcacacagttggccaagctgggactctgagtccagagctggcctcttaaatacaaagtcattgtatcccaaaattgttggatcatgtgaaccacttggaaatactggtaaaaattcgctttcccgaatcccttttctgggaaaaatggtgggtcttggtgcagccccacgtgattcttatgatcaggtgaataggaaaagcttccctaagctcctggccataggagttgagtagcaaaaatgctatgttttgtgtcagatgctctcagcctctatctgatatttgcattagccttaatttacagaagaggccacagaaaccagggagaagaatggccaagggtgatacagcaggaaatggcagagcagtatcagaaactcataggagcagagagtagaattgcagttgtcaggaactgggtgaagggaaaaatggggaggcaaggactaaagggcacaaagttttgggaacagttttattatgcaagataaataagttctggagatctattacatagtatagtccccatagctaacaatactgtattgtagactcaaatttcactaagatatgttaaatgttttgttttgttttttgagacaggatctcacagtgtcacccaggctggaatgcagtggtgccatcatggctcacggcagccttaaattcctgggctctagtgatcctcccacctcagcctctcaagtagctgtgactactgctgcacaacaccatgttcagctaacttaatttttcttttttttttttgtagatatgtgatatcactataatcctcagactagtcttgaactcctggcctcaagcaatcttcccatcttggcctcccaaaatgctgggtgttaaatgttcttagcataaaaatctaaataaacaaagagggtgggagaaaactatggaaggtaatggatctatctatggccttgacggtggtgatggattcactagtatatacttatctccaaactaatcaagttgtgcacattagataagaacagctttttatatgtcaattatactttaataaagtggtttgaaaaaagaaagttagctttctgattccagcccctatgctacacccaacactggtcttgattcctgcagaagatgtcagaaaaccttggaaacatggagccacacaaaagaaaagaggtttttttttctgcaaccagttcaggagtcagaatgccaggaaaattcaccccttgactcctctaatccagcctccaactgctgtcctcagtgcacttctaagatcttgccaatggtccctcaaagaaggcagcaaagtgctatgtttccaagtgacaagttgaggattttgctaagagcttgaatactgcagaatattgctccatagagaggcttgggaatagccttgaaaatcagaagctaatgcctccttttaattaatgctgtctctactaacagcctcttttgctttttcttatttcaatgagatcatcgtctattataaagcacacagacctgagagtgcacaaacacaactttccaggcctggttctgccactaattctctatgggaccttggcattggtgctcctgtacagtgtcagggttggatgccatgtctccaaggcttcagacagaatatagtgcagacaaacagactgagcattgaaggactggcttattcatttattagtgatacaattttaggcaatttacttaaccactgtgagcctcaggtatcccatctacaaaaggggagagtttagccaggtgcagtgactcacatctgtaactacagcactttgggaggctgaggtggaaggatcacttgaggccaggagttcaagaccagcctggccaacatggtgaaaccttgtctctactaaagatacaaaaactagctgggcatggtggcgcacgcctgtaatcccagctactctggaggctgaggcaggagaatcaggtcagcccaggaggcataggttgcagtgagccaagatcatgccactgcacgccagcctgggcgacagagcaaggttctgtcccagacagacaaacaaacaaaagaggagagtttgttcaaattgttctgcaaggcttttccagctataaattttgtggttcttcagtaactgaaagaaagaaattgacaagagaatagaatgatgtagtatagttctcagaggctgcaatatgaaacaggagagtgctgggagccttgaaggcatgactgttaagtgaactttggtgttaaacccagatgctaccactttagctgtttgactgctaggctagttagcctaatctgtctgtgcttcagtgtcccacaaatatgtctgtgcctttgcttctcagtgtcttacaatgtgctgagataagacagcatgtcttatcgtaagatgcatcataagatagcatgtctctgtccaatcctttgagatagcaatgggacttaatttgaccagaaatagaagcagaatttcactgctaggagaaagttatgatagccaagtttgtttctcactatgaaagcattaatggaagcacagaaaggtgattcttctgtcagtccagatttccgaacaccagaatggccagggcccctgccattcagggagaggcaggtggtatgaccaacacataaaaactttcacagtcaggccactgaagtttgaaattgtttgttcccaagacacaaacgaatgcattctgactgatacattcatttccttttattcataaagccaagttgttaatggctcctttgcaataggtgtgaaaatatcaaatgaaaaaacacataaagtattcagcataggtccagacacataaaaaatgtacacaccattaaaggggcggggggagggaaagaggtggaagggaggggaaagaaggtttcagaagcagcatgtttaattaatcacctcttaggaaggcactagaaaaatcataggccacaacagctttggagaccacttaataagaactgactcagtatcctcagtgggggaatgagtgagtgctactaacaaacaccagctttccttgaatccttatagaaagcccttcagtcttgccaagcgtgggttgtgggtgctgaatccccaaatcccacatcttaccccaaactgtcctcttatgctatacaatatgcacatctgataagcagacaagattgaaaagtccctttctaataaatctctcatgagctcctccagctctttgcaggtcattcttgagggcctattggcaaatgcctactgccagcagacccatcttatttatgatgaggcttttgcaaaatctaccactgtaatttgctcagtccccattcccaagcagcttttccttcctgtcatttctgagacaccaggttcaataatagctcttgactgatgtttatctaaatctctgcaatctataaccaaagtttacctttcttccttataggaatgaagtagaatgaatgtgggtaagagagtggggggggggagaataaaaaacaaacaaataaacatcaaataccaccaatctttggtgagtttatctcacttgaatagtctgtcaattcccacactgatcaagagcaaaggaaaggggattctgacagtgaccctacatggatcactgagaccaacacttagcaccggaagggataagaaacaacaaagcttgacatcacttaatggatttgggggcaatttggaagtgaaatcattggctcttcacatttccacagaacttgacattttaccaaaggcttcattcatgtcaatttcaacataattcctaatccagtggtctctctcagcaccatccagtctctcaaaacaagccccattcccttccgaggaataaactgtattttgatttttgtatgaactgtgtccttctttcttgatcttttcatgtctccttcagtccttccgtcttgcacacatttcccccttccccgccttctgctgtctgtctctgtacctccttaactctgttcactgctctacatctcttcttaattctttctttgcttgctgttccctcctgctgtgacatagactgttctttagtgtctcctctgtttttgtctctttctccctgcctctgctcggtctgactgagtctccttgtcactcttgccctgtctttatctttccatgtgaatctcttaatgtgcaccatgcttaatttttgcacacagtgcaaacccttggactgttcaggaaatatcaccacatgctcgccccccagaacaggctgtagcctacatgcagtgacctgaagaggtagctccccatggagtggtctttgcctaagatccctccttagttataaatttggtctccccctgtggcacctgggtcctcactctacactgagaacagggatagaacacatggctctcctcatcacatgctgatatgggatataaagtagttgcatacatcctttattgcagaacaagaaaccagggagcactggtttgggagtcagaagctaactttcagcatgagaggagttccaatcactgtgaatattgagccagttatattatttcctgagcttccgtttctccatctgtacaagtaaggtctgaaatagttaatctttaagttcttgtctagttcagagacattacatttttaagcgctttgtaaagcagaaatctgggttgctctttcagagattcaagagaggaaatgaaaacacagacctctcttatatcagcagttgctaggtggggtgatctaggcaggggcagggaggagtacaaagcagaactgcagctgtcacacaggagacactagctggtagagagtttgatatcctaggccagccaattgtcaggaaatgaggcatatggtgagacggctggtggcagtacttgctggctactctctagggctggaccagagattacttagaggagggaggaaaggaagtagtaggaggagagaaatgacaactgcatttgatgctgaaatatttgcaggctttcaggaatgtgaaggacaaaggagctccatcctccctgctgtctggagctcaggaagggagacttgaaaaagataaatttacggctgggcggggtggctcacgcctgtaatcccagcactttgggaggccaaggggggtggatcgcgaggtcaggagtttgagaccagtctggctaacacagcgaaaccccgtctctactaaaaatacaaaaaattagccaggtgtggtgtgtgcctgtaatcccagctacttgggaggctgaggcaggagaatcgcgtgaacctgggaggtggaggttacagtgagccaagatcatgtcactgcactccacattccagcccaggcaacagtgtgaggctctgtctcaaaaaaaaaaaaaaaaaaaaaaaaaaaagaaagaaagaaaaagaaagaaagaaaagaaaaaaaggaaaagataaatttagacccatcagaagtggcttgcctttccacagtggggaggcaactgacttagcatggttccaagaggatacatggtctggagatggaaataattgcaaagaaagtttagctgaagccaaggacgacagagcttaaatggaatagattgctctaatataatggtggtagtcttgggagttttctaaatcttgagggtcatcaaaagagaaaatcctggtctgttcactgtactcccctccatgggcaaatcagggcacttaggctctggctgttcagaggcaatccagggttgagaagttggaaacaattagcagagtatttgaggcagaacaatgacttctaatggacctaaaattgtgtctgggactggacagtcagtcctaggccagcctttaaggggccatgttctttctttctttctttttttttttttttttttttttgacatggagtcttgctctgtctcccaggctggagtgcagtaccactataggctcactgcaagctccgcctcccgggtttacgcccttctcctgcctcagcctcctaagtagctgggacaacaggcagccgccaccacgcccggctaattttttgtatttttagtagagacagcatttcatcatgttagccaggatggtctcaatctcctgacctcatgatctgcccgcctcagcctcccaaagtgctgggatgacaggcatgagccaccacaaccagcggtgccatgctctttctcactgacgagtctgttggccgtgggaagataagcactccaagcagtcaggagaactgagaacgtgggctggtcccacaatgacttgctttgtgaccaagtcctttccctgcatgtaaaatgagatcccaggatttaatgaagtttgttcaggatctagcctcttactacccatgtggatccttcttttggaccaagctatccttcacacaacagaatggtacattggctcaattatcaaatgccagccactctgagagctgctgtgagaaatgaaactccataaaacatacaatgtacctatggaaatggctggcttctgttaaaagcaccccattttaaagatgaagcagtagaattatgcttctcatgggtggggctgggatttgaaggcatgttcattggcagtctgttttcttgactcccacccttgcttatccatatgtctgggcctttgcaggctccttcctggacaggaaaatgccctttaactcttatctgtcccaagaggcactattctttgctatcacttcaaacctcagttcacaaactttgtcctttgagaagccctttatctttccttctaattcctttcaacaggcttccatgggaactctttggaaaccatcgtctttccttggaacactgctttgcaaattaaatttttctatttttttaaaacttgtgtgtgtcatcttgcaagcttttaaatttcttcctcaaagagaaggaataattcctttatttttttattttgtattccaagcaacattattctatccatgatgttgctcaagacacactttcatagaccattaaaattatagaaaactagtattgtagaatctcagcattgaactgcaattcatccagactatccttaaatttttcccagagcttttcctgatttttgttctttttttttttttaaatagagacaagtgttcactctgttgcccagactggattgcagtggcatgatcatagctcactgtaaccttgaatggccaggctcaagtgatggtcctgcttcagcctcccaagtagctgggactacagacatgtaccaccaagttcgaataatatatatatatatatatatatatatatatatatatatatatttttttttttttttttttttagacggagtctcactctgtcatccaggctggagtgcagtggcgtaatctcagctcactgcaagctccgcctcctgggttcatgctattctcctgcctcagcctcctgagtagctgggactacaggcgcctgccactacgcctggctatttttttgtatttttagtagcgatggggtttcattgtgttagccaggatggtctcaatctccttacctcatgatccgcctgcctcagcctcccaaagtgctgggattacaggtgtgagccaccacacccagcccagtttaaaaaaaaaaaaagttagcagagatggagtcttgcaaagttacctaggctgttctcaaactcctgggctcaagtgatcctcccacctaggcctcccacaagtgttggaattacaggtgtgagccaccatgcctggctcggagcttttccagtaaagtagcattcagtctctgcttgagcaactgagtcatggatccacctgccaacgatacctaaagtgtcagaggggccatttctatctccttttccatcttatgcccaataaccagcatggtatatgagaaagaggagattctcaaagagtatatgatgattacaaggatgaacggttttagtgaattcacatctccattctcattctgtaaaatgggagtaagagggtatgctgaattgaaatacaagagcaaggttttagagtcagctggagttacatctgattcctgactctacctcttactagatgatgatcttgagaaagtcactcaacctctctggattaatttctcaattgtaaaatggaggtcatagtgcctccagtgattctaataatgaagctaaaatgaaattatcttggctctcctacttcctagaagggagtctttggaaagctactctagatttctctttctcttctgtataaaaaggatgataatgactcctgcctcacaggatcattgtgaggattacataagttaatagacaaaaaatacttagaaaaccctttcgtgtatgctgaattaatgttagtggacattattattgttagtagttagtagtaaagaacttgacacagaataattattaataaatggtaaccatttattaccactcataatacaattatcactactattagtaagatgatggaatggaaacaatgattattataatggtgacttattactagttctgacttttattgatatgacctcaaatgattaggagagccttgctttgtgataatatctttttttttatgcaaacatggttaaaagtataatgtgtgtgtgtacgtgtgtgtgtgtgtgagtgtgtgtttagataatccttctccatacatacaacaaatctcactctactagcttatggttcttcaagctttgaggcataagtaagtcaccacttaaagtttctcttctttaggcagaacagtttcaactgtccaaaaaccctttaccaatatcttgcatctttaatcctcacataatctggccaacctagccgtcactcactattgagtgaaaaaagcaatttctaaacagctttactgggatttggggagtgtgtgtgtgtgtgtgtgtgtgtgtgtgtgtgtaggcagacaggaaaaaacagagagagaaagagagaagtagaaattttaagagcattcaggaaaatgttaattctaggtatttctgggtgatgcgatttttattttctactacattaaatgtccttatttttgaactgcctgaacagcatgcataaaatacttatttttcagtagactgaaagattaattaatgtttttcaaaatgccattaactgtacttatatgataatttaagattgaatttaaaatgtggggctagaactaggaaaatggcaaagtgggacaaatatatgctaggaccatgaaaaagaaaccttatggaataaagtttgatgactttccacactccttaagagggtacctgtgagcttaaagtgatgctggccagaataacaggtctctaccccattgtgcccatggcttcctccctgtgcccaggttgtttgtcagtgactcagacaagcaatgtgcaagtatctacagcatacctaaaggtcatctggaagacttggccttggttcacatgctgggtccggttgttgtaaccatgtagcatctctccaaagagggtatcattgaatttggagtcaggtttgaggcacttggggccctcgcagacatctgagagcattaagcaggattttccatcaggagccagtttgtactcctccacgcaactgtatgataaaacagagctcagaattagcttcacatcctgaatgcccccattgggggtgacctaaaaccaaggcctcctttccctgcaaaacaggtcagagtttaggaaggagacagctattctacctggaatctatctagggcacagatgtctagagagaagcacattaatactgcaaattggtaaattcaaggaaagtcatttgtgacattttggaggagtcaaggggacaccagcgtgcacgttcacacacaaagcaaatttaaagactgtttcccatgaacatacagactttaaaaagcatgacataccaattcacagggaatcatcaactagtgtctcaaaccagaatctattcccagtacatctgtcaaccaaggttgaagactgtagcaaatacaaggtttttatcatcctggtagctcagaggtgaaaccttccaggaccatggacagcacaaggcttctgttcacttagggattttagcagcctccgttggtctaacagccagaaaagcccttgacaagcctttgagacaggggtggcctcatctatggacaaaacaggcatctgaataaggtgtggaaacaatatttgcaatttgaaaagatttgcagtgacaaatctcagagaggcatgggctggaggggatggggatggttggggcaagaaatcagagatctcagcccctgaaaaatcattccagaaactggaattctatgagtgtctaccttttcaaagttcagcgctaagcactaggagtatggtgcacataaataagacagacaagagaatggtctgtgagattggacagacctgtacaaatgccatttttctccttgtgacctatatgaacatgagtgagtcatttaacttctatgatccccagtttcctcatgtgtaaaatagagtagacacttctaccttaattcagtaggatgctataaggtcacatgatacattggccacaaaaaaaacaggaattgcaatatacttaacacaataatcataatagtggtagtaatggtgttatttctatttattgagcatgtactattcactgaacactttatgtatttattatctaaccatgaagaaagaaagagtaatatcataatttctgctttacacataagcaaaataaggagccaagaaataaagcatatagtactgtgagtaagtagcaaagttgatattcaaattcagttctgttagaaaaagggatgtttgtctatttttgtctcctccaaatctagtgctttctatgtgcacaaaatgaccctggttggtatgtcagtttgagaaagtaaacagcaggcaatctcttatttgccttttttcaaagggtgtagcaaagattcattgaagctaaccgcaaagggactcaggaactcagatgggagaaggaagaggctctgtatggtggtttggaaagaaaatgtacacaggttgtgggaaccagtagctgatgctacagatatagagctgaactggaggcagaaagaagacaagcatagctggaaacctgacccaagatcactctagtgaaaagccaggaagtctcatgcatgaagcaaactgtcactgtttccttgctttcccctaatccctggcgtactgcactgatgcactgatggtctttctaacgttcaaatgttcctttccatagtacagtggggaaatctcttggaaaagggccctgtctcagagccttggtaaagtatatccccttctttttgcatctgttaaatattactaagtcccttttaatacagttgcagtgcagatgaaatgagtgtatatggaagtgaatcgtacatggtgagtgtttcataaagtctagttccatccatttattgagaaaatatggagaaatggtttactgggtacactggctagagttctctctctctctttatttctctcaccctccacacatacccacatccctgtgtgactgtgaataaatatattattgttgaagatgagtaaacattatcaaagtctggcagggcgcagtggctcacgcctgtaatcccaacactttaggaggatgaggtgggtggatcatgaggtcaggcgttcaagaccagcccagccaacatagtgaaatcctgtctctactaaaaaaaaaaaaaaaaattagccaggtgtggtggcagccacctgtaatcccagctactcaggaggcggaggcaggagaatcacttgaacctgggaagtgggggttgtagttagccgagatcatgccactgcactccagcccaggcaacagtgtgagacttcgtctcaaaaacaaaacaaaacaaaacaagacaaaaaaaccattatcaaagtctatagagtaaaatatggaacttcttcatttcccactcctcactttctgtcccagaggtcaccattgttaatttttatgtgctcttccaggagtttttcaatgcatttaaatacatattgtgtgtgtgtgtgtgtgtgtgtgtgtgtgtttgtgtttgtgtatacagaaacatttctttgaatctgtcgactaaattggggggatttatataaacacacatatgcacacacacatctcataataaactcataagcagaattacactatatattgttgtgagacatgcatttgcacctgatgcaatttcttggagatcttttcaaaacactatatatatagatctatctttcttaatggttatttggcattgcacagtataaatgtaccataatgcttttaactaatttttattgatgggcactttagctgtttatagctatttgttattacaaacaatgccataatgaagatctttgcacatatatcattgtgcccaactatgtgtttctataaaacagatactcagaaaagaaattgcttggttaatgttttatgaattttaaaattttgatagatctactaaatagttgcctgtagaatctctacccgtttacaatcctataattgatgaatgggagatcctatttttctacatctttcatgttcattactgccaatctaggataggaaaaataactcatttttgtttggatttgcatttcccttgttactgattaggttcagcatcttttcatgttacggtcacttgcatttctccttctatagattatccattaatatgcattgaccatttttctattgtgatatttgcctttttctttgtgttggtttatatatgctcaatattttctgggtagttatccttcaccttccatatatattaaaatttttttccagtctgtgcttgtattttaatcttgcttttgatatcttattacctctttcttctggtctttgtgtctgaaatttgtgcaatgtttagaaacccacaagacgataaaatatatttctgtatattattgtagtattgtatatgtttaaaaaaatctttggttatttaatatgcatggcatttagttttgaatgtagtgtgagtgtttattttaacttaactattttttaaaatgggtagccaattgtctgaagtgtctgacctttcaacaacaaatttgaaatgttattttttttttacacgtgcaatccctacatatgccatatatacatggttggtgtttttcctgtttaattatctgtatattcctgcagtaattccaagctgttttaattactatagctttatagcctgttttggatatagtaataaagtaatactcctccccttcatcaacactagttttctatttccaaatttcctgactgctcttccatatttttcctttcaaatgaatttcagaatgggcttatcaaattatatgcaaatccctagtggaattttgggtggcattgctttgaatttgtaaactaaattgggggaagattttaatattaattttatttcattttcttttatttaatatatacgttttgcgagttaactctgtgctgggcgcttctgataagtgtgacaaagacatcttgcattaaccacactgtgtcctcttcctggacttgcattgcattgggtcctcttcctggacttacatgtctaagcctgtcttgcagttgggctgaaggggccatgtaactggattctgaataatggaatctatgctgacatgattcaagtcactgccagaattagtcttttcaaaacatcctgtgatttttcaagctgcctcttcccttgttatggcaagcttggagaccatgcgttcccgatgcattctacaggatggaggaagactgccacaattacaatagaccgtgcacaaataagaaactagcttttgtgcacaagcttctggttgggggagggggctcatttgctacaggaagaaagcttatcttatcctaatacagcatctttataatttggagttctctaactgagaaacagtttgtatctctatttatcaactgttcttttaaaacatttggtgaagtttttgactttttgttataaaggttttgcacgtgtcttttggaggttattcatgggcatttatgaaaggcactatgctgtagaggtttatcgaagtatgttttggatccagactaacagagtccaaatgctgagtctgccacttaccagttgtgtgacctcggacaaactacttaacctctctgtaccgcctttgcttatctataaagaagatcatgtgtgccttttagagtgaaaattctactgttgcaatcttttaaacttcagaaataggatcagtttttcatttatgctttcttttatgttttctacatagttattactgacttgagaaaagctgttactgatttttcgaagttgatgttgcatcctacgaacataaagaacttaaacattctaacatgtctactaaatttttctaaatggagagcatatatttgctcagtttgggtattaggattatggaataagttaaaaaactatccttttttgtttctttctctggatcagtttatataagatagatgttatccattacttgataatttgataagtcttgcctataaaatcccctgggctcgatggcttcttttcagttgtagatatttagctcttatcatttatttccttattatctgcctatttagattttctatatcctcatgactcaaacttcgtaatttatattttctaacattataatgtattttatcaagactttcacatgtattggtgtaaagttctatgcagtgttctcattaaatttcttttatcttttatgtttctatagttaaggcactagctcattcgtaatgtgttcgtgttctttctttgctctctcctttgaataggctttttgtattttgtattttattggtgagctcccttttttcttttctatttaatttatttcagcttttatttaattccttcctgctgttttatctgactttgttttataattctttttatggctgcttaagtcaaatgcctcatttgtttattttcaatctttcttgcttcttaataaatgtcttgaagcttctgactgtggctttgcccacaccccataagtctgacgtgcagccctcatgctcctgctcatttctaatgaggtgaaaatttgagtttgattttttccatatccaagtgtcacttagaagatatttaaaaatataattccaaaatagataatttgtttgttcctctttttctaatattactgcatttttagactaacagtgtagtttgtataatttctatgttggtaaatttttgagattctaaggtagtcacaagttgagattttagagctaactaaacttgagttcaaatacaggttgtgccatctaccagttacatgaccttgatcaagtctgctaatttccgcaggctttggtgtcataatctattaaggaaaatgacaatccttatcatggggatgtgaaaattagagataacttatacaaaagatgaaactgtatctctcatatagtattcaagtaatgcatcagctattatgcttattattgttattgttgttgttacttagtccattaacccatttacatatcccaggaagtataaatttatttctattggttctcatatcctagttgctggcctctatctagatccagatttctgaaagttgacatagttgccattctttgattccttttttgtttttctgctgcttcacagtgtatgtttgagaacttcttatgttgcattcattggaaataaggtatacatataatttgtatatatttttacatgtggaattatcatatagaagttaaatatatgcattatttgtgtgtgtgtctctgagtgtgtgtgtgtacatacacacgtatttgcaaagctcagtcccacattcaggatcccaaagtttagtggaatgcttttgtatatatgacctggtttgctccttataacctgtaataggtagaataatggcctcctcaaaatgcccacatcctaatcccgaacacctgaggttatctgacatggcaaaggagactttgaagatgggattaagtaaagaattttgagctggaaagattatcctggattacttgggtgatctcaatgtcatcacatgtttcccataagagggagataagcgtgttagtcagaggaggaaatgcaacttagaagcagaggagaataagaggggagcagagtaacggaccatgagtcaatgaatgcagatgctccctagcagttggaaaaggcaaggaaatagatcttcccctaaggcctccagaaggaatgcagccctgccactgtcttgattttaagaatattgaccttgagaactgtaaaataaagtgtgttattttaggacactaagtttgtggtgattcattacagaagcaataggaaatgtgagacactcacagggaggtattgtctccactttcagatgagaaaattgaggtttacagaagttgagtgacttgcccatggaggtatgtctagtcaatagtggtgctgggaatcaaaacttaggagctcaagacgtgtgtgtgaatgtgagtgtgtgtgtacgactttaagcatatcacaactgtggatttacagtgatttttcttttccctgtgggtgggaaaagattgtggcttgcaggagagattcagggggaaaaaaattcccatccttgtaaaggaaaatgatcccctgagttttgaaacaggagcagttctcccccgccgagccacctaagggcataggaaggtttatgctaaggtctatttagttgttgggttttttttaaattttatttttgtactatgacacataattatatagcttctttagaacattctgtcatctgggagattttcctacagaaattctaaagagtgtaggctcacaggaaaccagccaagatctacatgaaactctatttatacatgtgccaaaatgaaaaatataaaataagtgcagagatacataccgggcattttagctgaaggcaatggatgtgttacccttaacacacccatcacattatagagaataccaaaactagatgggattttagagagtgcaccataaaaccttctatgtgtttagctcagagcatgttttatttaatcctcatagcaacattgtgagatgggtactttcattccaacattgtcacagaggatcctgaggcttgggacatctaagctcactaatcaaggtcacatgagcattttggaaaagccagaaccttgacttgggtcttcttactccaaatcctgtgctccttccagttaattacaaatgacctcttcctatctgtttgttgtttgaaggagaaaattgagactgacagacaaatggtattgtgtacaaactctcaaagcaaagtatttctttttctcatgtattttttccttatttattaatttattcttcaatggtttgtggaatcaacagaattatcaaaatacatatcctagaaactttttgaaaataaggaaggaatcaaatccttaaaaatattaagaataggccaagtgcgatggctcatgcctataatcccagcactttggggggctgagactggcggatcacctgaggtcaggagttcaagaccagcctggtcaacatggcgaaaccccatctctactaaaaatacaataaattagctgggtgtggtggtgagcgcctgtaatcccagctacctgcaaggctgaggcaggagaattgtttgaacccgggaggaggtggttgcggtgaactgagattgtgccattgcgctccagcctgggtgacagagcaagactctgtctcaagaaaaaaaaaaaaaaaagagagagagagaaaagtagttaagggtaagaatagctcaaggagctgcacaacaggtagacttggaccaacgttaggaataaatctaagtatcctattactaaggcaagaaaggaacaggttccttcccagctttcctagtgcagaaacctgtgaaaaccccaccctgggatcatcagggctagaaccagcacctaaggaactcaactgcattaacccttctaactgatatcatgggaatctttttcaccaacaccctcaggattgtcccaacattaaccaaacgaagatcagaggaggtgttctctgagcggtcttgggttgcaggttttattcaagggaaaatttagagtttctagaaaaagaaaagaaagaagtgaatagaaaatggaattccatgggaaactctggattaattatatagcagattttatctagtctaagacccctaataatggtaagaaacactctcagtttacataacactaagaaagaaacaaggaaaaaaaaaagactgccaaataaactctgtcaaatcattaaaactaagataccttcccacttcagaaatgttaaaatgtggaaaatatgggcactttagaatcaatgaaatatgtttctccactgcatgatttgggagagccttgactatccccaggcacactgggaacctgtaagaggcagttaggagtgcagatttttccacatgggaaactctgaacatttagtttgttgttgttgtttaatatttgaatgtctcatggaactaatgttccatacaatccacactggaaaatagctatccaaacaaatggatggatattacgtgtttccatcaattgtcggtgagcattttttacacctgagcttttacaaatgtttaaaaagaagagaaaacaaggttataatgtttgacaagaacctggcatgaaagtattctatgttaacgattagaagtaaaattcacgttctccaaccagaaatgaaaggggtaagggctcaggctttaacctaaaaggtggaaaccacaataaaacaagtgcctgaatgaattcccccatctcccaccaactcttccacttgttactgataatcaaaatgaaggccattgtctctgttctgtcgttcagtgttttctactgttagactagacttcagctttgacaatgaaaatacgtggcttccagttactatgcatattaaacatgtttatctcctttccctcttaaaattacataaagagaatattagacagagaggctattaaggactatttgaggctggatgtgttatttgagctaatgtgtttttagggcactttcatttaaattggaagcaagaaggttgggatatctcaagcttctatcccaattttacctcctaactggccgtgagtgcccccaccttgagggcctcagtttcctcctctaaatgatctgaaaaatactgaaacttaaaaaatgttaatgaggccgggcgcggtggctcacacctgtaatcccagcactttgggaggctgaggcgggtggatcacgaggtcaggagatcgagaccatcctggcaaacacggtgaaaccccatctctactaaaaatataaaaaattagtcgggcgcggtggtgggcacctgtagtcccaactacttggcaggctgaggcaggagaatggcctgaacctgggaggcggagcttgtagtgagtggagatcgccccactgcactccagcctgggcaacagagcgagactccgtctcaaaaaaaaaaaaaaaaaaaaaaaagttgatgaaatggctcactatctcttacataggaatatatgagaaataactctcttagcaaataacggcagaaaaaggtgtataactcctgaaaacaaaacaaaacaaaaaaactacaactttccttttctcatacaaggacaactatataatccactatgggtattttttctctttctctgtttactttggttgccaagaagcacacagccaaatttatctcatgttgagtgactctttcattttgagcttctgaaaccattttctctcccctccttaaaatggctctgatgattcctatctttatatgaatagccttttaaaaatatattgtctttatgtgagtaaaataagttctcttggaagtgtgcatggtagactctgtaaacacatacacacacacaaaacagacaaactttgttgctaggtaacttgccaaggtcttcacaggaggtgatgccctctcacctataagactggttctaaggatttattctacaggctttagcttagtgtccaatgaccttctcaatctatcttgaattcacctgcttctgtctaccattctggtacttgtgctctgtcaatatcaatcaggacccagtgaggcttaggcacctctttgcccctgctggagaagaactctactcaatgattatttgcacctaataaaagaccaggcacagagtagtcacaacaaatcttaggcggatgaattctttaattcaatcattatggttctaaataagtctttgggccaagcagtgggaatggcaatgaagacatgcagatgcctaggatgtagtccctgctcatgaggagttcacagtatgacagaaacagacaggaatgcaggtaaatcaaccaagctatgaggctatcacagggagagccatggggcctgtgcagccccagagaaaggatgatttactctgttttggagaacgtaaactgatgagagggcagccagccagaggtccagtctccaagagatgtcaagatttcactgggataaataagaatttgagacaaaatgtaaatattcctttcccttgtaggtagaaatgaaaataaataaataaataaataaatagacgagggaaaatgtcatttctatataggccctaaccccatgcaacattcagccaatatttaaatagtatccatttgaaaggatgaatattggccaggcacggtagctcacgcctgtaatcccagcactttgggaggatgaggtgggcagatcatgaggtcaggagatcgagaccattctagctaacacgctgaaaccccatctctactaaaaatacaaaaaattagctgggtgtggtggcacgcacctatagtcccgggtactagggaggctgaggcaggataatcgcttgaacccaggaggcggaggttgcagtgagctgagatctcaccgctacactccagcctgggtgacagagcgagactccatctcaaaaaaaaaaaaagaagaaagaaagaatgggtattaattatcttgttccaaggtaactgcataactcacacctgatgcctcttagggctcagagaaggcttgctgaaaaagtgatgcctgaattgaaacttggaggcgaaagctaaagggccagggacaaatgggagtcagtgggggtacaaaggagaaagagacaggagacagagggaacagtgttgtgaaaactccagaaactgaaaccaggaggcttaacttaggaagaggaacctagctggaaatgaaactggaaaagtcagactggaaacttctttagccatgttaatggaggaactttgcttaacaactattaattgaaaacctactatgtgccagtcactgttttagctcctggagacaaagtagtaaacaagagataaaatccagtaattacataattaaatgagatggttttatacttattagactaattataattatggtttactgagtgcttaactatgacagctcctgtgcatgtataatttcatttaatcttcacaatggtgctacaatcacttctaattctacatgaaagagcataggctcagagaaattgagtggcttgccaaagatcacatgactagatgtggccagaggtcagcaatgacatcagatctgtcttgactgagcctggaaccacaatacctaagtttcaatctcaacaacctcacttaccagatatgtgaccttggacagttactgagccactctgtgctttttttaaaaaaaaaaaacataaaatgggaatcataatagtaacatcgcttgtagaattgttatgagaattgaatgagctaatgtacccaaagcacttagaacagtcatggtacgtagaaagtcattagtaaatgttagctgctattattaacctggttgcaaacagatttattaaaccttctcctacccagaacactcttaggaaggtcatagagctttgagcaagttgggaaggtccccttgataatgagtttattttgttttccctgcttaattcaatagcatcccacttctctctggaccatctctctcacaagtatctgctaatagctttcattgtttacagtgcttctaacaagtgtggtaacttctcatttgcattcctaatagacagtttccaaatcctgttgaaactgcagttggttttaggatgcctgggttttgttttttgttttttttgtttttgtcctatttattaccatttggatgggttttaacagctcaccacacactctcacccattcaatcttctttaagacgctcacagtcctttcacaatatattaacagattagtcctgtctagtgcatcaggtcactagcaaatgttattagaatcacttaagttaatttatttaacaaacacatacagtgctaattctgtgcaggacattgttccaaagcatttcacaaatattaatgtaaatggtaatatatttagtccttataacatctctatagacagatattactattatccctgttttacagatgagaaaactgaggcacagagacataaattaacttgctgaaggttacacagcaaggagatgttgagccacatcactagtcatatgaccttgggcatgtttcttagccttcagagggtaacaaatatgaaatactttcctctcttcagaattatcattatattaaggtaggtattaaaattttactggtgagaaaatggaaggtcaggggtcctgaaaggcttgccttatggctaagggagagtggcagagctaggattacaattcgtgtcttttgaatccacggttccctgtaatgtgctgtggatggaaggtggtaatagtttctgatgtcaaaatccattattgctgctcctgctgctgttactgttattatttaccacagaagaacagcccccaccccaccccaaacacacagagagaaaaataacaatgacaagaacatggctgattctggatgcagcctgcagatctaaagccatgcataatttactcaacactgccctgcagtcacttaagctgaggagagatcgctataaattcaggtctgcataccctaatttatttcttatttattttgctgatacatatctagggcctccagtgagctgcttctacacctgcacaaaggcacctgcagccctaagtgcaactagggcaggaaaggagaccttgaaataagccctggaagaaaaactggactctacacactagaatcatacaagtttaattcatttttctggtaaactggaattaaacccatgcccacactcaccccctatttgtgaaacacaggactgaaaatgttgttacatgtcctgttctgcttttctatcttagtaaagacagcattaaatgtacttcttccatgagtacaagattatttttctgagtcacagaatgtcaaaagataagcaaatattctaatactaagacataatcagaaagggaatgaagagaagaaaaaagtctgttcttgtaagtgattactaaggaccaaatgctatatgcaaggtgctgtcaaaggcagaagtaatggccattgcagtctttaaatggaaagcaatgtaagttggaagaaatgtcagccatccttccccaaagatctcttttcacagatggtcaaactgtggcccagggagagaacatgacttgtcagaagtcactcagcaagttggtcccaacgtgttccccttttagcctcatacttatttcaaaagtcagtttgagtccttcaagagccagagctgtcctacaagcttcacctgtgttgtttcctttagccctcccctcctccagttaattgtccttacagatacggacattaggacacagaaaggctgaacagtgccctcacattgctacattcctgctgaaaccaagcttgaaggctggacttagcctgtgcttttatgcaccatacctgaagcctttgtgaaccttcaagacgtctgcttttgtctccaaactgcactgactaggcccatacaggtagattcagaagggcaggaggcttcagcaggaaaaagctcctggctctaggatgaggcctgggcatgggttatatttattacatttattaacccaatctttatttttctcatttttttcttttttaacccacccaacagaaggttatacttttggcttttggctcttggactaaaacaggaaaggcagaaaggccattttattgaaggtcaaggttcagccttgctgagctgtagtgtctgatcattttcccatgcatccctcacttctgtaaatggggcacctgggccttggggacagagactcacccgcagaacatgaagatggtgctcgaagtggcatcgtagggcaggggcagcgtctgctgcaggcacagctgctcacagccgccattaaagccatcagagcagtcaatgcctttggagtggtcgtagcagccagagccatccttcatgggtttcagctcctcagggcactgctcagagagagggcaacagggtagttatggcttgggaggttgtaggccccatcacaccctctcctccctcctggaagagacatgtgtcagggcctgacagaaaggtattcagtctccttttgtcagttaataactttgtgacaagttccacaagtccctttacttctctgaacctcagtgtgcccacctgtaaaatgggacttttgtgactatctgcttatagtgttgtgagaatgaagggtgataatgtcagcaaagtgttgagaacactggctcacacggcaacagcacagcaaatgtcagctgctgctaatattgatattgctgggatcatattcattattgtttctactgttattgccctatagggtctactgctagaagggtcacatagggaggctgccagatatatatttaaaagcctctaccagtatgagtgtaatttccagcttttcctcttctcactgtgtgacccgagaagttacttgccgtctctgagcctcaatgttctcatctaataaatgggcacaatacctgcaactacagatttgttgtgaagcttaagttggatcatgggggtgcataccttacttcggaatttggcacataatttggtactcataaaatgtgaattaccttccttcctgtcttgaattagtctcttcttctccaccattatccctggagccctaagtaagattcctgcatactcacatcaccatgaaaagggctcctagccagtctgctggactccagtcaggccttctcaaaaccatcctccaaatggccaacagagtgctatttctaaatagcatcactccccagcttaaataagtaaatgaatcttaaaacatgtgaagctgctataaactgataatcaaggtcctccctttatagacaacctagtcctctgcttggccatatgcacagccctccccatagccctctggtccctaagtaaactccaaggagttcaaccttcaatggcctcagctagaacgctcttgtcagtgggtctggcacctgctatgtgctccttcagtggaaaatcatatactgtggagacagatggctattgattaaatttagttttccatcatttgatgaggctgagctcatcttctccatcccagctgatggagaagtagttccaatactcctgctttcagaagagaaaatgaggtactgggtttttatttcagtcctcccgctggcatttcttgtccacaaagattaacacccagagcccagccttcctcatccatcaccggacatcactgattaaaatgccttcccaccatgagaccccaccggccaactccccgctccccttcccatgccatcgtcctaaacaacatcaataataaaacatactcacaaaaattaatttacaaaaaccacaataacaaaaaaaaaaaggtcagccctcttggaaattaaattttgcctgagaagaatttgtaattacaaatgcatgagagagttcttcaagacatttgagactggcgccaggaagagtgacggagaaagtaggttataaatggcctttgtcaagctgcagaaaggttataaaactgctgcattttgtgcttaaaaaatcaattttccatgtgagtgaagtgctgtacatattaatacaagctcagaggaagcccctgcttgtctctgaacattcactgtcagacaagagggcacctggtcacagggtcatttggagccgtttgtgagtactggggcctggcttcagtctgtttgcagactcgcggagcatgttgaaaagaatgactgattttctgaccaggtaacaggagacacctgggcagggtatggtctcagtccttcccatcccccaatgattctctaccacacttgtttttttaaacgtgttcactaagctccaggttttatctaagcgctttacccgttttaacttatttaatccctatagcaaatatatgaggtagagtggtaggctgataatggatcccaaagacatgtctctgtcctaagccctggaacttggaatctgtgaatgtgactttctatggtaaaggttatgcagatgtgattgtgtcaaaactcttgaggacaccctcctgggttttccagattggcgtaaatgccatcacaaatgttctcatgacagagaggcagaaagaaattacacacacagaggagaaggcgatgtgggggtggaacagagattggtgtgatgtggccacaaaccgatcgatgctgaggccaccacaacctgaaagaggtcaggcacagattctcctctagagcctccagaaggagcaccaccagaaatcaaatgccagcaccttgattttggatttctggcctccagcactaggagagaataaatttcttaataattatcttaagccactgagtgtgcagcaatttcttgcagcagacaaggtaggtaccgtcaggattcccactttgcagaggaggaagcggaggagagggtcacacagtttggtggtgacagaggcagagcttctcaggcttcccaactttgttgctattagctgcctaatgggcaagccacttcaccaccctgtcatttactgactgactgatctctagttttaagaagtcctgtcatttactgactgactgacatctagttgtaggaagtcctgttatttactggctgactgacatctagttttaggaagttagaataaggcagggcttagagctgatctaacctccttactttagaagtgacgcccagaaagttaaaggacatcaccccatattcctcagcacatgagcgaagaacgtgaagccaggcttcccttgccccagcttggtgttctctgtccactacactcacttcccttcaggttaaagcattttgcaaacttacatatcctatagtctctctccccaagatgatttgctgatgggaaactgaggatcagaaaggtgagggtacttgaccaacatcacacagcaaattaaaggcaagatttgatccacgcctgtgggaaaggcttcctaagtacatgaagtgggtttaccagttaccatcattccttcctctatcatggacttcaggtactgtgcctttgaggatgagtaggggcagatgagatctagccatcgtttgaaattacttgtatattattagtatttcaattagtttgttgcttactgtctgtctcctccaccaaaatgtaaatgttataatagtatggaccatgtggcttgtcctaagccatctggcacacagttggtacttgttatttgctgaacgaattggtggagtgctagaaatgacatttagtgtatctgtgtattaactttggatctgaatccacactacttcttataagttgtataaccttcaggcagtgacataaagtctcctatcttcacgtgattactgtgatgggtaaatagtacggtagccagcttcaaagatggtccccagtgattcctgccttctggtattaagactcatgtagtcccctcctacactgcaccagaattggtctatgtgaccaatagtatgtggcagaagaggaggtatgtggcttctaaaggtagatcataagagagatctttctctccctctgtctgtctctctctctctcatcacttgctctagtgaaagcaagctgccatgttttcagcagccctatggagagtcttatgtggcaaggaagtaacacctctggccaacagccagtaaggctggggcctgccagcaaaacatgagtgagcctgcaaatacactatccagccccaatcaagcctgttcagatattggcaaccccaggtgacattttgactgagactttgtagaggtaggccagaaccacacatagaagctgcttttgaatttctgacccttaaaaattgtgtgggataataaatactttttgttttaagtgacttgatttttgagataatttgttacacagcaatagctaactaatatagtgaaataaatgtatgcagtacttagcacagtgatcaacaaatagttctgctgttataggtatttgtaaagagcttagaatctggtttgagagataaatatacacatctatcagagaacgttagttatagaacaaacataaaaaagtatggtaaaatttgtttgggaaaataaaaactctgcaaactaggcaatattgaaacagggaggttttagtcttttctcctcctctaggaagggaatcctgtaggaaggaagttcctacaggaagagaaaagagacatctaatgtactagaagaggaagactagaattcattaccaggcactgtcacttgcttgcctcgtgaccttggacaagtccttgaaactatttgggactgttttctttctataaatagaggagccagtttggagacaagaatatgaggactaaagtcaggcctgaattccaaggaaagatttgtgacactgagcatataggcaggatgcttcacctcagagacagcctcaggttcctcatctgtagaatgcaaataatgtctctcttggaggcacttctgaagactgtatgagaaaacacttctaaagtatctggctttagacctggtacataatagacacctaataaatgaagaataattgaatagggatatataaacaagtaataaattaaccaaaaccccaaaagaaaaactagcctagttgggaggaatcacgatgtctgactagatgcaggtagtatgtccctcctccatggagaggaaccagaataataagtagatacacacattccaaacagattgtctagaagagaatgctaggattcaacaggggagaaatgagaagcaccagaagtaagtaagcagagactttgaggcagcttttccagtcagaaaccaactgagagctggaaggggctcccagatgtggggaaacagtaagagagaaacccccagggttccaaaatggggttttacaccttggctgtgagagaaactctcaacctactggggcctttggcctgacatacgaagtgcctaaagtttgcataaaaccattgccacagaatgagaacccaaataaaatcccacaggcatctgaacctggagtagacacagctgggcactattttgagagccaaaatactggggatctacagatatggctgctgctgccctgttctaaagagggagagggaagactgggtgctcccacacatccccaggaagctccttactgccctgctgcaggctgctattgagactgagacatggatagactgtacttcccacagcttcttgctcacctttcttgcctgagatggactctgccttctctggtatcaggcccaaagcaccgtttttgacagtttaatgctgagctgcaccctaccattggcatgagtttgggttgatgtggctgcagctgccacccagtcaaggagggacagggagaccaggctatcctatgcatatctaggacaatacccactgccctgcaaggggctgctgtgagaccaagactcaagtgggccacactcaccacagcttcttgccaatgtggctcacctgagaaggaccccatcctttctggtcacagcccacagctggcaccatgctgagcatttaatgctggactatgtcccaggcttggggccgagtttgaggtaacatggctgcagccaccaccctgctgggagagggacagagtacaccacactctcctaagcacactcaggacaatacccaccaccctgctatgggtggctgcgagactggggactagcccgcccaacccatcacagctcccagcaagaccaacacgggttgcttgagtcccagtgggttgctctaccaccatcattactgccatcagccacactacactagcttcccaggggccccaaaatctacccatacatcaggcccactgctcccactactagcttctaagcaagccaactaatggcccaagaatcagccctcaaaaacctactaacactgaagccagtgtaagctacttcggggcctaaaaccaggcacactcaccccactgctgccactatcaggtgtgaagactggctcactttgtattcaaggtcccagcttaacttcaccacaatctcaactaacaactgtgtgataatgaaaacacagtatctcaacatgtgtattatacagcaaaatcagtgctaagaggaaagtttatagcattaaatgcctacatcaaaaaattatcacaaattaacaacctaatatcacacctgaaagaactagaaatatggctgggagtggtggctcatgcttgtaatcccagcactttgggaggctgaggtgggcggatcacctaaggtcgggagttcgagaccagcctgagcaacatggagaaaacccgtctctattaaaaatacaaaattagccgggtgcggtggtgcatgcctgtaatctcagctacttgggaggctgaggcaagagaatctcttgaacccaggaggcggaggttgcaatgagccaggattgcgccactgcactccagcctgggcaacaagagcaaaactccatcccccccaaaaaaaaaaaaaaaaaaaagaactagaaatacaagaacaaaccacacccaaagtaagcaggagaaaagaaataacaaagatcagagcagaaataaatgaaatagacccaaaaagcaatgcaaaggatcaatgaaatgaaaaaataattttttgaaatgctaaacaaaattagtaagccactagcaagaaaagagagaagactcaaataaatacaaccagaaatataaaaacagacactacaactgatgccacggaaatacaaaagatcatcagagactattatgaagactattatgttcacaaaccagagaacttagaaaaaaatgaatatattcctgactacacaaaacctatggagattgaaccaggaagaaacagaactcctgaaccgaacaataatgactactgagattgaatcaataataaaaaatatctctcaataacaacagaaaaagccaaggactggatgaattcacagctgacttctaccaaacatccaaagaaaactaacaccaattttcctgaaacaatcccaaaaaaatgaggaagaggaaattctttctaactcattctatcaggccagtatcaccctgataccaaaaccatacaaggaaataacaacaacgaaaaagaaaactatacactaatatccctgatgaatatagatgttagtattttgcttaacaaaatactagcaaaaggccgggcacagtggctcacgcctgtaagcccagcactttgggaggctgaggcaggcagatcactaggtcaggagtttgagaccagcctggccagcatggtgaaaccctgtctctactaaaaatacaaaaaaattagctgggcatggtggcacacgcctataatcccagctattcgggaggctgaggcaggagaattgcttgaacccgggaggtggaggttgcagtgagccaagatcatgccactgcatgcactctagcctgggcaacagagcgagactccgtctcaaaaaaaaaaaaaaaaatactagcaagtcgaatccaacagcacatcagaaagatagtacaccatgacatcatcaggtggaatttatccctgtgatgtaatgaggattcaactatgcaaatcaataaacgtgatacatcacataaacagaattcaggaaaaaagccatacaataatctccatagatacagaaaaaaaagcattcaataaaattcaacatcctttgatgataaaaaaaatcctcaacagagtaatcattgaaaatacacacctcaacatagtaaaggccatgacccacagccattatcttactggggaaaaaaaagcatttcctctaagaactagaacaagacaaagacatcccctttcaacactcttattcaacatagcactggaagttctcaccaaagaagtcaggacacagaaaaattaaaagttatccaagctggaaaagaagaagtcaaattatccctgtttgctgatagtattgtcttatatctaaaaatccctaaagactctatcaagtttcaagataaaaaataagatgcagaaatcagtagcatttctatacaccaatctagctgagaaccaaattaagaaagcaatccatttacaatagccacaaaaataaaatatctaggaatatatttaacaaggaggtgaaagatctctataaaaataataacaaaacactgatgaaataaattgtagatgacataaatacacagagaaacatcccatgctcatgaattggataatcaatatgtttaaaaggattatattgcccaaagcaatctgcagattcaatccaatccctatccaattaccaacatcatttttcaaagcattagaaaaaaaatcctaaaattcatctgtaactagaacagaccccaaataaccaaagcaatctcaagcaaaatgaacgaagctagaaaatcacattatctgacttcaaattatagtacaaggcatagtaaccacaaaaccatggtattggtataaaaataggcaactagatcaatggaatagaatggagaacccagaaataaagccacatacctacaaccaaatgatctttgacaaagtcaacaaaagtacacactggtaaaatgatactccagttgtattagtccgttatcacactactataaagaaatacctgagactgggtaatttataaataaaagaggtttaattggcttatggtttcagaggctgtacaggaggcatggctggggaggtgtcaggaaacttataatcatgaagaggaaagaggcacgtcttcacattgctgggagcaggagaaagagagcaaaatgagaagtgttacacactttcaaacaaccagatctcatgagaactcactattgcaagaacagcaaggggaaaatctgcccccatgatacaatcacctcctaccaagcccctcctccaatactggggattacaattcaacatgaaatttgggtgggaacacaaatccaaatcatatcactggtcaataaatggtactgaaaaattggatagccatacacagaagaatgaaactggactcatatttctcgccacatattttttaaaaacctcaaaatggattaagacctgaaactataaaaatcctaaaagaaaacctagaaaacaccattttggaccttggccttgggaaagaatttgtgactaagtcctcagatccaattaaactaaagagctacacagcaaaagaaactatcaacagagtaaacagacaacctacagaatgggagaaaatattcacagattgtgcactcgacaaaggtcaaatatccagagaccataaggaacttaaataatgcaacaagcaaaaacaaataaccccattaaaaattgggcaaaagacataaacagacacttcttaaaagaagacataagagtgacccacaaacatatgaaaaaatgttcaacattactattcagcagagagatgcaaatcaaaaccacagtgagataccatctcacaccagtcagaatggctactattaaaaagtcaaaaaacaacagatgctggtgaggctgtggagaaaaaggaacacttatggaatgtaaatgagcacaacctttaaggaagacagtatgaaggtttttttttaaagaactaaaaacagaactaccattcaatccagcaatcccactattgggtataaacccaaagagaaaaaatcattaattacattaggtcggtcacggtggctcaagcctgtaatcccagcactttgggaggtctaggcaggtggatcactagaggccaggagtttgagaccagcctggccaacatggtgaaaccctgtctctactaaaagtacaaaaattagccaggcatggtggcaaatgcctatactcccagctactcaggaggttgaggtgggagaatcacttgaacccaggaggcggaggtcacagtgagccaagatcgcgccactgcactccagcctgggcaacagagtgagaccctatgtcaaaaaaaaaaaaaagaagaagaagaaaaaaagaaagataccagccctcatatgtttactgcaacaataataacatacgagtgctatttcataatagcaaaaatacggaattaacctgaatgtctatcaagagttgattgaataaagaaaatgtggtatacactcctacccctcccttctccccacccacccacagacacaccatggaatactactagggcataaaaaagaatgaaatcatgtcttttgcagcaacatggatagaactggaggcctttatcataagttaaataactcagaaacggaaagtcaaatatgacatgttctcacttgtaagtgggagctaaacaatcggtacacctgcacgtacagagtgcaatgacaaacactggagactacaaaaggtgggagaatggaagggtgggaagagtatgagggttgacaaagtactactgattgggtacaacgttcactattcaggtgatgggtataataaaagctcaaacttcactactacacaatgtatgcatgaaagagacctgcttataccccctaaatatataaaaataaaaatataaataaaggtaactgaaactattagctgattttttcttttccatatgtctaagtccttctttagaacatttaacaaatattcaccaaacacctacctactcagtgctaagcaaatgttttaggagctgaaaatgtagtagtaaacaagacagacaagacctttctctcatagaatttacattctagagaagagacaaataattaacaagtaaacaaacaaaatgattattttgtagagtaaaaaaatgaataaagataaaagtataatatgataaaaagttaacgaggatggggtgaaagcagcataaatttagcttaaaaatagggtagacagacttcttccactttagccttctttttcaaaagaagttttggccattatagttcctttgccgttcgtttaaattccagaaaaatcttgtctatacttataaaaatcatgccgaggttttgataggaattatattaaacctttatatcaattcgaggcatgtggacatctttattatcttgtgctatccaattcgtgaatacgtatatctttccttgtgattagatcttctttgatttctttcacgagtattttaaagttttactaaagctaaacgtggcccatgcatattttgtcagatttgcatctgagtatttcattactttttagggattgcaaatgatactgtattttttatatattttgtcagattcacatctgaatatttcattatttttcagaaattgcaaatgggattgtattttttatttcaaatgttcacatgttcattgctagtatataggaatacaattgatgttgtatatttttcttgtattctgagaccttgccaaacttactaattgcttctagaaatttattttgtagattccctgagattttctatgtaaaaaaatcatgtgatctgccaatgggtaagtcttatagtcttatttcttcctttcttatctgaatgccttcttccttttttgattttttttttccctgttattgcactggctaggacttcccacacgatgttgaataacagtgggcagagtgaatctgcttttcttgtctctgaccttttggagaaagtattcagtctttcaccataaatatgtcagctgtagctcttttattgatgttcttcgtcaagttgagtaagttctcttctattcttattttttttttgaaagttttaaaaatcattttcggtatggaattttgtcaaatgtttttcttgtatccattgatatgatgatgtgatttttcttcttctgcctgttattataatatactgatagattttcaaatagggaaccattcttgcatcactgtaataaaccccacttagttatgtgtatagttatcttttatgtattgttgaatcctatttgttaatattttgttaaggatttttacaactgtggtatatgcatgagggctattggtcttactttgtagttttctgtttttgaactatctttgtctgcttttagtatcaagataatgctaatgtcttaaaatgatttgggaagtattctctcttctttaattttctggaagattttttttgttttgttttatttatttatttatttattttttgggaattgacgtttattcttctttaaacatttggtatatttctccagtgaaactatccaggacagggatttggagctgaggggaggaggagtctaaagtgacaaaataaatttccttaatagttatagggctttcaaaattatctatttcatattggcgaattgtggtagtttgtgtttttaagaaattggtccatttcatctaattcatcaagtttatgtgtgtaaaattatttgtagcattcccttattatccttttgatttacacaaggtctgtggtgatatcacctgtttcagatagtggtaatttattttttctctcctctcttccttttcagtcttgcttgtgtttgtttagttttattgtcattttcaaataatcaattttttgtttcattaacttcgttgtttttctgttttctaccacattgatttccttccttcggcttcctttggatttattttgctctttttttttttttctaggttcttgaggtgggagcctagattattgatttgtaacttcctcttttctaatgtatgcatttagggctatacacatccttctcattgaatataaagacacagatatgttaaaagaaaaggatgaatcatgacttcagctgtgtcccccacacaacttgatacattgtatttttatttcatctagttcagtccattttttaatttcccttgagacttcttctttgacccattgattattcagaaatatgttgtttactttctaagtatttgaagatttttctgttatatctattatgggctgaagatttatgtccccacaaagatttgtatgttgaaatcctaacccacctgcaaagtgatgatattcgcagttgaagccttggggacgtgattaggtcacaagagttaagcccttataaatgtgattagtacctcacaagaagaggatgggagaccagagttccctccctctccaacacatgaggacacagaaagaaggcaagcaaggaaaagggaatttcaccaaaaaacgaattagccagcacctcaatcttagacttcagcctccagaactgttagaaataagtctgttgttcaaagcacccaatttatgttattttgctacagcagtccacagctgctgaaggcagctgttattgctctgttattgctttcttgtttgattctatcgtggtcagagaacacactccatacaatttgaatcttaaaatttgctgaggctttttttatggtccaggatatagtcttgtcttgatatgtgtcctgtaggcacttgaaaataatatatgttctatttttgttgggcataatgttctataaatgttaactagatcttttttgttgatggtgttattgagtccttctatattgttgctaaactcctgtctagttcttctatcggttttggaaaggggtattgaagtatccaaccatcattgtagaattgtctattttttctttcagttctgttagattttacctcacacattttgcagttctgttgtttgatgcataaacatttaggatttctatgtcttcatggtaaatgatattttataattatttggtgtccctctgtggtaattatttggaaggcctactttatctgttattaatatagctactctcacttttgtttgatttgcatgtgtctttttccatccatttactttcaatctgtctatatcattataagcaatgtgaatttcttgcagacagtatataattaggtcatgcttttaaacccactccactaatttatgccttttaattttggtatttaaactatttgcgactgggcacagtggcttatgcccgtaatcccagcacattgggaggctgaggcaggatggtcacttaaggccaggagtttgagactggcctgggcaacatagtgagatcctatcttttcaaaaaattgtaaaaattatccaagtattgtggtaagtgcctgtagtcccagctacttgggatgttgaggtgggaaggtcgcttgagcctaagaagtcgaggctgcagtgagctgtggttgtgctactatactccagacgacagagcaaaatgctgtttcacaaaaaataagaaaaaatttctaaaacagaaattatttacatttaatgtgacctgaacatttctggcattacattatattattatgtttcaactccaggtcttaattatattaatgaagaccaattctgatttttttcttgcccaaattactatctgaggggtctggggagtcatgccctacaaatcataaattctcatcagatgggtttatttaatcctatacattgtgacttactttccaatctggctctggcataacatgagacaaggaagaaaaggcaaaatactttatcccaaaacacgtttcttgacatattttgaaatggccctgcaaagctgttctttgtagggaaaattttgcatctgtaaagaatgtctattaacatagctacatctttttctttcagaccctcccaatcctaaagagattaactaaaatctgaataggaaacatttgttgtctatagtctctaagggcagccactaaaagacgtcaaaggaactttggtctccacaatctttatcttaaccagaacatccctatatccctatagtctggaaccaacaacccgctgcccccaaaagcatttgtaaaatgtataaaacaaagctgctccctgaccaccttgggtacatgttttcaggaccttctgagggctgtgtcacaggccgtggtcactcatatttggctcagaataaatcttttcaaatattttacagagtttggctcttctcattgacatgtatttatttattttagagagaggttctctctccgtcacccaggttggagtacagtggcacaatcatagctcactatagcctcaaactcctgggcttaagcaatcctctagcctcagcctcctgaatagctgggattacaggtgtgagccactgcacccagatagaccttcaaaccttctattttctctggcttctactgacactcatccagcaggggaaggtagtggccttgttactgacaagggaatgaagaagtcccagttccccatgtggccttctctgataccccaaaggcccctcttttcagctggatgaggtaggaattcacctccccactaggacttcacggatctcttcctggatgggagtggtaggtatgtctagtcactgttccccccttaatctccactaacaccacactgagtggaaggtggccccatgaatgctggtccgtggtgaatgtcctggctttctactagttcttccctgacaacaacccagcaggaagggggaaggtgcttcaatgtcatggattaggggtggaaggccatgctcttcactgatgctgaataggccaggggatgggggtgctcactatctatcattgagattaaagtcctggctccccacgccattcaaccgttgctcccatggggaggggtgtgttcattttaatttttttcattttctgtggtgtttggctggagtagagcacttattgtctagcatttttctgtcttgctaggttgtccttttcccggtattttggctagggagagcagttttgttttgttttgttttgttttgttttgttttgttttccttcacatgtacctactggcatttctgagctgcaggctcctttagctccaagaataggacacatgaggcaaagagagaatccagggaactgaccaccatgtctttccttgggtcccaaaggcttcagctggtctgcaatgctccacctttcagtcttatgcttgttttatataggacatccagggtttttggttgtatttagccagaaaaatagagaaaatgtgtctactcctccaaagcctgtttttgcacagccctagagctaagaatggcttttacattttttttttaaaagaacatgagacaaaaaaagaccacatgtgacctggaaagcctaaaatatttactatataatccttcatacaaaaaagttgaagacccgtgacttcagccatgttaaggcacctggagtttattctaagtgcaactggaaggcataggagggttgttggcagaggaataaagtgattttgtttgctactttgaagagattactgaagttagtgaatccagttatctctaagcaatttcctagagtccacaaaaggagtctggggaagcaggctctgtgcatctgggcaggggcttgagaaagggagtgagtcagcctaataaggactctagcatgtggaggcgtgcctctttgctgaggttttatagtaagtaggtgagaaagcggggagtctaacccaggtcagtgcagctccagagactcatatccctcattctgctctatttcaggggaggactcataggaagactctgagcccaagtctctgagccttgagattttgaagacctagcggggagggagaggaagatgcctggaggattcccataggttcctcccacaggctagccctgctgggctcccccgagcttcttcctccatactgtgaacctgctctttgctgcttcctagctcgacttttcatcatcaccaagccatttgtttctgtttgtaattatgcattttaatgttcattaattatggaatgcaaattgctctgagtacaaaatttgtaatgagctgttttaccaccccacccccaggtctagaaggtgggccagctgttctgagcagaaggaaaaacaaccaacttacaaaacagaacaatttgtcctagggcctgagtgaatcatatggtaaataagcctgggggacttcctgctgatgctggaggtggggccctgccccacctgggtcctgggtgacatcagtgtggcaatttcattctttgctacaaacttgggcctgaaaggcaggtggggtaaaggaacagcactagtcttagaaccagccttttactggctatgacaccttgagctagtcccttggcttgtctgagcctcagtttgtccttctggaaggtaaggattatgatgaaattatcctcaaagtaggggtggcaggcaaacactagcaggccctggataaatgcatgtgaatggctctccagattgctggattccagttctgcctggctgtgtttttttttgttttgttttgttttttgagacagagtcacgctctgtcacccaggctggagtgcagtggtgcaatctcggctcactacaagctctgcctcccaggttcacgcgattctcctgcccaagcctcctgagtagctgggattacaggcatgcaccaacacgcctggctaattctgtatttttagtagaggcgggggtttctccatgttggtcaggctggtctcgaattcctgacctcaggtgatccgcccgcctcagcactcccaaagtactgggattacagctgtgaggcaccgcacccagccaaaaatttccagttgctttcttttctttttgagatagagtttcactcttgttgcccagactggagtgcaatggcacgatctcgactcactgcaacctctgcctcctgggttcaagcaattctcctgtctcagcctcccaagtagctggaattacaggcgtgtgctaccatgcccagcaattttttttttttttttttcagtagagatggagtttcaccaggccaggctgatctcgaactcctgacctcaggtgatccacccgcctcagcctcccaaagtgataggattatgattacaggcgtgagccactgcgccctgcctgggctgtggtctttaactggctgagagccttcagatgagaacactctgagcctcagtctccttcaatggaggcactggacagcaggaagtcagagaagactttcagtgctaactgctcagtttttatcaaagcaactgtgaattgtagaaaggggaaaattagctctgaagtatttaagaggaaaatggggaattttcttggaattgattgaacatgttttaagacatcacaaggatgcctccaaacctgcttgactatgaacaatgacttgttctcctccaaggactaggtaagtatttgatttctttaagtctcatggccagagaaagcataataacagtatcacctcctactaatagtactcctctcaacaatagtatgcctcaaaaattatggtaaatattttttatttattgttattattttttacagacaaggtcttactctgtcacccaggctggagtgcaggcagtggtgcaatcatagctcactgcagtcttgaaatcctgggctcaagggatcctcttgcctcagcctctcgaatagctgggactacaggcatgtgccatcatgctcggctaattttatttttatttttattttttttaaaacaacagctttattgaagtataatctacatatcataaaatttactcatttaagtatatgattcagttattttaaatttgcagaattgtgcaaccagcaccgtgatccaatatttaagtttccatcatccccaaagatcgttcatgtactccttttgagacagagtctcgctctgtcacccaggatggagtgcagtggcacgatcttggctcactgcaacctctgcctcccaggtttaagcgattcttatgcgttggcctcccgagttgctggaattacagttgctggaattacagccccgtgtgtgccacaccggtctaatttttgtatatatatatttttttcctgagagggagtctcgctctgtcgcccaagctggactgcagtggcgtgatctcggcatactgcaacctccacctcctgggatcaagcaattctccttcctcagcctcctgagtagccgggaccacaggtgcccgccaccacacccagctgatttttttattttattttatttcattattattattattattattatttttttttttttaattgatcattcttgggtgtttctcgcagagggggatttggcagggtcacaggacaatagtggagggaaggtcagcagataaacaagtgaacaaaggtctctggttttcctaggcagaggaccctgcagccttccacagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaacaatttttcttagtacagaacaaaatgaaaagtctcccatgtctacctctttctacacagacacggcaaccatccgatttctcaatcttttcctcacctttcccccctttctattccacaaagccgcgattgtcatcctggcctgttctcaatgagctgttgggtacacctcccagacggggtggtggccaggcagaggggctcctcacttcccagtaggcgcggccgggcagaggcgcccctcacctcccggacggggcggctggccggacggggggctgaccccccccacctccctcctggacggggcggctggccgggtggggggctgacccccccacctccctcccggacgaggtggctgccgggcggagacgctcctcacttctcagacggggcggctgccgggcggaggggctcctcacttctcagacggggcggttgccaggcagagggtctcctcacttctcagacggggcgtccgggcagagacgctcctcacatcccggacggggcggcagggcagaggtgctccccacatctcagacgatgggcggcagggcagagacgctcctcacttcccagatgtgatggtggccgggaagaggcgctcctcacttcctagatgggatggcggccgggtagagacgctcctcactttccagactgggcagccaggcagaggggctcctcacatcccagacgataggcggccaggcggagaagctcctcacttcccagacggggtggcggccgggcagaggctgcaatctcggcactttgggaggccaaggcaggctgctgggaggtggaggttgcacgagccaagatcacgccactgcactccagcctgggcaccattgagcactgaatgaacgagactccgtctgcaatcccggcacctcgggaggccgaggctgtcggatcactcgcggttaggagctggagaccagcccggccaacacagcgaatcccagtctccaccaagaaaatacgaaaaccagtcaggcgtggcggcgtgcacctgcaatcgcaggcactcggcaagctgaggcaggagaatcaggcagggaggttgcagtgagccgagatggcagcagtaccgtccagcttcggctcggcatgagagggagaccgtggaaagagagggagagggagagggagaggagactgactctaattttatttttattttttgtagatatggagtcttatgctgaccaggctggtcttgaactcctgacctccagtgatcctccatctcagcctcccaaagccctggaattacaggtatgagccaccatgcccagcagtagtaaagatgaaatgagaggtgaaaataacgagactaaacacataatgaaagccagaatacactgtcagtcacaaagaatagacacaactgtgaatgaagtctgactgagccacttcctcaatgtgtgccctggctgttctgagtctcagtttccacaatttatacattggagaaaataactccttcctcactaggcttgtgagaggatcccaggaggtcatttacctgatatgtgcctgatgcctgacaggtgctcactaaatgctaactgctattgtagttaccttgttactttctccaaataggacacattcagggagaaatgtaagggaaccatatacagggaaatggttaggcatttcttccatgcctacttttccaatgaggaaactaaaactcagaggtcaggtgagctgccttgggtcatacagcaagcaagagtctgactgagcccaccactgaaggccccctgactatggggccaaatgaggttctcttttccctgaaccacatggaggtggcttgtctgtggtgttacaagtggttcagactggctagtgtaacacagagattctgagaaccttgtgggaagggccctgtaatgagttatcggaggactttggtgctttagggacagagaggttgcttgtggcatagtcttggatgtacagattaggtacagcatcttgggaagaagagatagggaaagatgcaaggaaggaaatgaaatgcatatttattatgcacctaccataagctggatgtttcccaatatgctatcttttttaatccccacaaaactcagaggacctctaagatacaatatactcattttacaggcaaggttattgaagatcacacaggctgaagaagggctgctgaattcttcaatatgaaccatccctttgataagaaactgagtgggcctggttcttctcatcccaggagagctctggtgtgcttcctggcatataagtgagtgggaaaggctctgccagtccccagtcccccacccctcttgccactcagcctcaatctgtcaaccaggccagctagcccgtctattaatgctgacattgatttggatcaatcaagatcccataattactgggagttttaatcaactcatgccaattcagctgccgctcaatttgtgctggacttcggtgctcacaaggagggaagcggcgagggtggggtggggcggggggagggcatgcaaaaaggattacagggatcaatagtccttggtaatgaaggacagcagctgcaggcaccaccagggggcctgagacttcagagtggaggagacagagcctgcccccatcccccaggagagctccctggcagagaatgaaaaccacgcccctgcttcacctctgcctacacctggatctggaaaccacttaggcactaccaggcagcacctgttctctgcagggtccaaccctcagtatctctctccacattttgccctcagccaggcctggcctcctcttcctgaagaatcttatgtatccttcagagccagcaatcccattactgggtatacatccaaaagaaaataaatcgttctaccaaaaagacacacgcaaccgtgtgttcattgttgccctattcacaatagcaaagacatggactcaacctgtgcccatcaactggtggattggatttaaaaaaatgtggtgtgtatacacttgaaatactatgcagccataaaaaaatcatgtcctttgcagcaatatggatgcagctggaggccattatcctaagctaattaacacaggaagagaaaactaaataccgcatgttctcacttataagtgggagctaggacgggcgtggtggctcatgcctgtaatcccagtgctttgggaggccaaggtggatagatcacctcaggtcaggagtttgagatcagcctggccaacatggtgaaaccccatctctactaaaaatacaacaaattagccaggggtggtggcgggcacctgtaatctcaggtactcgggagggtgatgggggagaattgcttgaactcgggaggcagatgttgcagtgagccaagatcgtaccattgcattccagcctgggcaacatgagcaaaactctgtctcaaaaaaaaaaaaaaaaagtgggagctatatattgggtacttatggacattaaaatggcaataatagacactggggactaccagatgggggaaggaggcagggaggtgaaagggaagaaacaggtgcaaggattaaaaaactacttattgggcactacgcttagtacctgagtgatgggatcaattgtactgcaaacctcagaatcacacaatatatccaggtaacaaacctgcacatgtaccctctgaagctaaaataaatgttgaaattattttttaatcaaattttaaaaaactctgtaaattatttctcagcagtctctgtggttatgttcctgagttcaaaaagcagaagaatgctgaggagacaaaaaaataaaaataagattaatccagatactgtcatttcctagctgtgtgacttcaggcaagtcactgcacttttctggtcctgtttttcctgttctaaaatagactcaataataaataaccgcctcctgggattgctgggaacattgagtgctgtcacgaatgaaaaatccttgtgtggaagttccttcttccttttgatgtcccacatcagaaagaatcagttttctttttctcccatgttcattattcttctcctagcacaagctttattctgccaggtgggacggtttctgggtcacagtctgtttccctacgagtccacagctatttggggacagggactgtaatacacacagcttccttttctcagtccagcacgtgggagggagacaagccagtatgcaaggcaaatgtggcctttggggtcaagcaagcttgggcttgaatcccacctgtctttgccacttactaaccatgtaatgttagccagtcacttcgttaacatttgaacctcaacttcctcaaagtaaaatgagcctaattacacctactcagaattgctacggaggaaaaaaaaaaaaacaaaaagttagacatttaatgtccctaacatagtatctagcacaatggtaagatcctgattgttataaaagttgctattatgattattatcactcttaatattcagtgctcagtaaatatttttggaatgtaataaaatgtctggttgtattgcttagttttggcttgagttccaatgaaataccaacaggccattatccccacatgccagccatctgtgcagccttcaacacacacttactgaagacaccagaaaggaaattcaaatgctttcaggacacactgtgggccaggcactataggaagtgttttccttatactgctttgctgaaggcccacacttctatgagattgctgttattgctgttattagcttgatgtctgcagaagagaaaactgaggctttgtggctggatatgtctttccttgtagttctagcagaaccagggtgcaaacatgggggcgtttgactccaggcccctgctctctccactgtaccataccattctttcttttttttgagacggagtctcactgtgttgcccaggctggagtgtggtggtgcgatctcggctcaatgcaagctccacctcccgggttcacgccattctcccgcctcagcctcccgagtagctgggactacaggcgcctgccaccatgcctggctaattttgtttctcttatttttagtagagacggggtttcaccgtgttaaccaggatggtctcggtctcctgacctcgtgatccgcccgcctcggcctcccaaacgtaccattcctttcttgtggaggcaccaagaagtagaaaatgtgagagttcccgacttcaggaagaatctagaccaatggtagagatcaggtaaattcccagagggagaaaagtcatagttcaaaatggcttatgataaaaaatgtgccaaacaacaaaaaacaacctgattaaaacatgggcaaaagacttgaatagacatttctctaaaaatgatatacaaacagccaattggcacatgaaaagatgaccaaaatgattagtgaatcattagcgaaatgcaaatcgaaactacctcaccctcattaggatggctgttaccaaaaattcagaaaataatgagtgttggtgaagatgtggagaaattggagcccttgcacactcttgataggattgtaaaatggtgcagctgctatgaaaaacagtatggaggttcctcaagaaattaaaaatagaactaccatatgatctagcaattgcacttctggatatatatccaaaagccctgaaaataaaatcctaaagagatatttatacacccttattcatagcattgtcattcataatagcctaaaaggtaggaacaaccaatgttcattgacagatacatatacacacacaatggaatattattcagccttagaaaggaaggcaattctgacacacgctgcagcatggatgaaccctgaggacattatgctaagtgaaataagccagtcacaaaaagacaaatactatatgactctatttatatgaggtgcttatagcagtcaaattcacagagatggaaagcagaatggtggttgccaggggctgggggaagggagaatgaggaattatttaatgggtatagagtttcagttttgagagataagtgctgtagattgggtgtacaacaatgtgaatttgcatcacgctaccaaactgttcacttcaaatgcttaaggagataaattttatgttatgcatatcttatcacaattaaaacaattttaaaaatgtattttaataaaagggaagcagagagtgaaaggcataatggttcctaacttcaaagaaaatctagaccaactggagggaccggatcaaccccaagagagagataagccatgtttcaggatggtttctgatcaagagcagtgctgcaatgacagcatgctactgcgtggctgggtttgctcacacacactgatcacagctaattatctgaatatatgctggctacttttcccattagaggagtcccacgtaattaggggacacaggttaccatccttgctttgggcacatccctgcccttctctggccgtcaatcttcctaactgtccagtgagaaaagtggtagctggtccgtaaggggtctcccatcttggacattctatggttctctgccagtggtcaataggaattccaagggaggtaggttctcgcagtaggcagcacctgctctagtgcaagtggcttgggaacatgcttgaagctttcccctacagcctcttaaaatggctggtcaaccttttggtggcagtcgcgaagccttctgcacacagcaagggttcagttcaacaaatgcctattcagaacctgctgtcttccaggaattataaagccttagcttcattctcaaaaaaaaaaaaaaaaaaacaaaaaacaaaaaacaaaaaacaaaaaaaaacatatattctaatggggggagaaaagtaagtaagcacattcttatagttctcaaggttttgttttgttttgttttttgagatggagtcttgctctgtcaccagactggagtgcagtggcacaatctcggctcactgcaacctctgcctccctggttcaagtgattctcctgcctcagcctcccaagtagctgggactacaggcacacaccaccatgcccagctaatttttgtatttttagtagagacggcgtttcactatgttggccaggatggtctcaatctcttgaccttgtgatctacccgcctttgcctcccaaagtgctgggattacaggcatgagccaccgtgcccagctgaggatttttataagcaccaagggctgaggcaagggaggccagggaacactttcctaggaaaatctgccaagactcctgaggaatgtctattcaatacctatctggtgatgataataaatagcctttgtgtagctcattaataataataatagctaacacttaatggcacttatcatgtgccaggcactgtttcgatgtgttttgaatattaactcattatgtgcacagcctgatggtataggaactactagtctactcattttacagagagggaaactatggcacagacagctttaggaacttgtcccaaggaaacaaggcaagtgagtggcacagccaggatctgaagccacactacgctgccttttacaatgtgttaagctttctaagttacttcctcatctgttatatttttctagcctcatggagagaggtgctgacgccatttggaagaataatatcctgaggtgcagagatgtaagagaacttcccaagatcatacagtgattagatgtggggcgggacagaggctccactcaggtctgcactgctacaaagctgtaccctctgggctgatggcatggctcagtgaaggagctctctctgttcccaaggcagaggctctaactgtcttcacctgggttcaaggcgctgggaggaaaatgaacatctgttgtgtaccccccatacaccagacacactgctaggctatgctaatttatgaaatcttcccaacaacccagaaaagaatgcaccattattttcaccactcacagatggaaaacaggcttggagagggaagatgacttgcttcaggtcctcaccatagatgcttggatgtctttctgttttcagaagcctcatgtcctattacttctctgagtagcacagagccgagggaattttgctacagatcaagtgcagggaggtatttggggaaaatagcttattgtgacattgcctgagcacttgactatgaaaccaggtctcctcctaagagcattgaatgtgcattaactcattccctcctcaaagcaaacctatgtggcaaacaccaaacaccaatatcatgcccacttaacagatggagaatctgaagcgcagcacgaagaggtgtattaacttgatgaaggtcacacggccagtaagtggtggagccaggaagcctggcacctgagtctcttttcttagcccttccgcaatacttcctcatacaacaaccatgtaaggtagtgtgacataggaaaaacaaactcagtttctcctgtgataccctctcaccacacaatcaacacagaacacttctgtgacctctggtcaccaagaagtgtgtggcaatttctctctggcagcaaccagttctctgggagatctttcagcagacaccagctgggtgtcctctaattcagttcaattttgacactatctaactggagatggtgtcagatcccacaggttgagtactcagtcccataagactgcctccaatttccactgccaattccaagccccaggttattaaacctgtgcttctgatgaccagctataaatcagggttcccacaatcccttccttgggtttcatgaacttgctacagcagctcacagaactcagggaaatacttatgttccctggtttattataaaggatataccaattatcaccagatggaaaagttgcacagggcaaataatgtgggaagaggcacggagtttccatgccctgtctgagcacatcgtcctccaggaacccccatgtgttctactctctggaaactcttgaacctagtccttttggatttttatgcacacttcaatacttagacagcattgattaaatcattggccactggtgatcaacttaacctttaagcccttctccccagttcagaggttgggggtggggctaaaagtcccaaccctctaatcttgtcttggcctttcctgtgaccagccctcaccctgaagctacctaagggtggatagccatcagtcaactcattagtatacaaaagacacttatcactttaatgataacaagaattttagaagttatatgcccagaaacagggataaacaccaatatatattaatttgcaggtactattatttcaccctttttttgaatactgggagattaagacttaaagaggtttaaagcaacttgtctcattacagaggaagggatcgagacaggatttgaacctgtacagcttgataccaaataacttgtgcctagcagtgagttacttattcaggggtcagggccaggccttcattagggcaggctggacatacggacttttccatgctgctaggtttaacaggctggtatcgcttccccatctcttgtcactaaaaactcaattagcagcttgaggctgtgtcctcacatcacaccttctcattgatcactcagactgtgagtgagaaagattttaaagctggttggctttgcaaagcatagagcagcaaccattgagcatatgcttctgtgggtatatatttattcagcttatgttgagtataattttggatggtatgcatattttattttttgttgcagagagcaatttaaaagaagaaaaaaaatccttctctgaatggagacagatgccatatatgttggaccctcaggggattgaaaaggatgaggttcccaagtccagtgttctggggacggacgtgggtggaaggaaactcacaagtgatgggaatccaggatcaactgcaacacccacagcaaggccagcaaggcactaaccacccagtccagggcagggcccttcaaggttttattcccaaggcctccccagtagcctgtctgactgttctctacatgctatttactgagtactaaatattgagtgatgggtgaagtgcacatcatcccccttaactttccccacaactccatgttgagatgctgttgtacatatgagaacacagatactacattgcccaatgtcatcaactagaacagcaggaatctgtgtgctgggaagccagaccccagaaccagtgctctcaaatccccaccaatgtcatctagtggttactggagtccttattttggagtcctgatatccatgctaccaattcctatctgagtgacaatgaacatgtcacttccctttctgagttggcttccacactcacaggatggagactgagataccattttgctagggtgttatcaagattcagagatccaaagttacacttaaaagtcatttgagacatttgttctttttttctaccccaccccctgcctaaaaggttctcctcttacccaggatgaactcaagatgtaacattttaaaatgagccttaggaaaaaacctgcaagggttggtaccagctggagaaaaataaatacgctcatgtgggtgccaaagattcaaaagagagaagcagcagcccaaaccagagtctacaccagagggaatcattatggaaggagaaagttcatcctatcattgtgcagaaaggaaggatccatgtgtgactctagggagtaggatccaaagcatcattttctagctctgtaaatagactatggactctttgctagttaggacacagtatctttctaatgttagggcccagaagagggtcttacacagcagtacttagttgttgagctctgaatgcagctaaaattcaactgtgggttgtctaataaccagtttttgcttcaaccaaaggcaagtttgatctagtttgataagatgtgctagatgctggagaatccattaccaacagtcaagaatcacataaaagagctgctctatgcatacctaagtgggaaaactgtaaaaaaaacatgattagcataaaagacagggtcttggccacttccagaagggaggacagggttacaattggaaatggaggcatggtgggtgtgttgggggagggcttatggaatgcaggcaatattctatttcttgacatgggtgatggtttaggtgagaattgcttaattcgtatcaaaactgtaaataatgttttacatatttttctatatattatattgcacagtaaaattgctaaacatctatctatctatctatctatctatctatctatctatctatctagttatctatctatcttatagtaaatctactaaaaggacatgtcaaaatgttagtagtagctatttggaggtgacatgactatgggtgatattgttctttattttttctctatatgtcctaaatattcttgtatgtgcatataataatttcataattaaaaaaaaacacgttttagttgaattgcttcattacctaaataaggcaacaacaaaaacgtgaaggtcagttccaccacttctgcctgaaattcctccaatggagaacctcatcttctccctaaggttcaatgtgcatgaaagaacagctctgcagagtaagttgaggggtgccaaatcccactggctcttatataggcctatctgcagtgtcttccccctctggaaccaagtacatctttgacttaggtactgtggcgggaaagggagatgccccagagagaatcaagtttaactctgaatttgtaggaaggacaggagcatagctgaggattcacagtaaacagagtcatgttgagaaacagggtcccttcatcacctcggactgtattatccccatgatcatgggcctgaaaaatcacctttccctttcagtgatgatgaagaaaatttctgaaaaccaaggaaagccagaaaaggctactaagtttcctagctcaacaagctcctctctacacaataggacctgatcttaggaagggaggccatggccctgggttttgctcatgcctggctactttcactgggtccggccaacaatattgtaaggtgcagggatcattcccattttatggatcagattagaggggctcagatacattcagcaatttgtccaaagtcacacagcttcccagttacagggatgggatttgaatccaactctgaattatggacaagtctattctttttactggactggaattctgattaactagcccatctctctctaggaacgtctgtcactcagttcgggtagaattttctcaatgaggagaaaggctattgagtgtttgatgaaaccttctcactgtttgctccctcaagggaaagggatttcaaaatacctgggctagtgggtcaagacttcttaaagcagggatcagagagaagctggagaatacaggcaaaaggatacctttattatttgtaaaatttaataacaataataataatgtcatttgtcatccatttatcctcaagacctatgataaaagacaaaagaatgatgataaaaataaaagcatgttatcctgggtggaagagagtcctacactggaatttcagacacctgggttctatccaagcatagctcttgtgctctttagcctcaatttgatcatctttatttattacccaaggggaaaatacacacacacacacacacacacacacacacacacacacacggttaagatcaagctaggaagtcagttgtcctaaaaagaaaaaaaaattggaaaagctctaggaaaagcagaatgtgtagttctgacttagaaaattgtcccgaagaaacacaactgtatgctttttatgcttccatttttaaaattacatatataaattcttatttatatttgcatatgcatagggaagaagtgtatggaaggatatgtatctatctatatatacaccaaaccgtggcacatttatctaaagtgggtgagtagttaagaaagggggccttgagtttttttctttatacatttcaacactgtacaaatttattttattttataatgagaatgagctacttttagaaaaccaaaaaaaatttttaaaggaagattgatgatcagatggagaaaataccttatgaatgcaaaaattctattattataattaagatgaacacaattattccagcttttcgtttcagagctaaggagaaggtgtctgatgatcagcattctgatgcctcaggagacactcactggtgcttggcacaaccactaaaagttctgtagtcatggcttctgacctcctcaaaccctcaaggagacagcagacccacggcctcatttactctcctctgcattgcctcttgtatctggaccctctctcacagacacagtgcacacctcactggactccactcccacatgtactacatttattttatcactctcctgatcagagaccctttaggccaaataccctagcccgcccttgggctgcactctgaaagaaaagcagcacctaaaacagtgtggagcaccagatgctctattgctccttttgaaaaaatccatcccacaccttcacccaaatcatgaaacactaatacaatttgaaaactgtccttacagacttctgggaatctcttctaaagaaacagctcaaaacacagaaggtggcttctgcccaaaggtgctcagagcagcacggtttataatagactaaatctggaagcaatcaacatgtccaaccagaagacaaagcaaatgctgggatgttccccttcatgaaatattaggcaatattagtgatatatatgaatttgtcctggttaagggttttgttatcaacctgctttggcccaatttggcccgaattccctgctctagaactgagtagctttgtggtcctgagcaaattacctaagttttctctggctcagttttcccatctgtaagaaaagggataataatgagatccacctcagaagccttgaatcatagcaagcattcaaacaattttagctctcatcattgccaccaccaccatactcaaccctgcatgagatatcagataataataatagcaaccatgttttgtgcctgcttagggccatgttctagcccattgcgtatgcattctcagttagtcctaacagcagctttggcaggcataagtagtattatccccattttactcaacaggaacccaaggctaagaggctttaagtaacttttcccaaagtcacatggctagtgaatgacaaggtaagattttggcccaggtttctctgatgctaaaaactgtgtacttaagcactatagtgtcttcccaaaagtaggggatggtagtgggagatggtagtgggagcagtgatttatgcagggcttgcagacaacagttgggaaaactaggagtgcagcttccatttcctgcctccaatttggggcttccttctctctttttttttttttttttttgagacaagtctccctctgtcccccaggctggagtgcagtggcaccatcttggctcactgcaagctccgcctcccgggttcacgccattctcctgcctcagcctcctgagtagctgggactataggagcctgccaccacgctctgctaatttttttgtatttttagtagagacagggtttcaccatgttggccaggatggtctcgaactcctgaccttgtgatccgcctacctcggcctcccaaagtgctaggattacaggtttgagccaccgcgcccggcctcccttctcattattccccccccaccattatttcaggaatcaaagggtaaaacccatcactttggaaaaaggggggctgcttcctgactttaacagataatgacttccacacaataaaaccagcttaccagaaataccatcagacccagcaaatccaagtcccaacgaaataaaataaggggaaaaatagagaaggcttcaaatgtcatgagaagaaaaaaatatttaatgtcataaaagggtgcataggctttatgagaatgccacacacaataatcttggaaaccctattaccccacctacccacccagcctgctccaaattcataaaggaaagatgcaaatgcactgattggaaagatgcaaatgctcctgattgaggagctactccctccttttcatttcccaaactttgagtcctgtgtgcaggcattgaatcagtggacacagtacagttccaattcccttctttactggctattcttatgtccttttccaatacagttccaatttccttctttactgactattcctatgtccttttccaatacttagcctctttagcttcctctggatctcttggatgcagtggaggagaaataaatactggacattgatagagggtaaagagaagaaagtgcccctctcttcatgcttcctgacattggggacattcgccttatccctagggaactattctcagccttgggagggtgtcttctgatgaattaagagaatgagctttggagtttgacagagtttggagtttcctctgcctttacctggctggttggatttgggcaagtttctcatactttctgactctatttcctcatggataaaatgggagtaataataatgctttccttataaggtagctgtgaggatttccagggccaggcacataattagtactgaaatgttctctctatatatccgtatcagtaatactaggcctgatattatttatagcatttattcatttattttttagtagctttaataatattaggcctagtattactgatcaaggtattcaatacatatagagaattctctgtctgtgaacctatttgactagaggatactttgatgaagacaccatgggggcgatatgtcatcctgtaaatcctgttttgcaacccaagagcctgaagttattcccataaagacacctgcctgctgcctttgcatctttctaataatttttaaaaagaaaaatagggcaaccatcagtcctctcattttggattttggcaaaatctgtctcagttgtcttctgaatctatcataccccatgtggctgatctacagggataaatttagctttgaaagtccatttctggaaaggaaaaacaagtctccaagggctagatcccatggaggctcagcccagctgcaccgtgtaggagggttacatgcccaggcaggcagggctgggctttccctggtcagcagtgcctgggctgtgctccaaggtgatttctcactctgctgactcttcttgctagtcttccccacccctcttgagttttgttcctttaattacactgcaattgagtcattaagagggggaaaggatgaggaatggagaaaagccggtctctctcccctactgaaccagattccagcttttgcctccctctgagcagtgctataaggttcctggcctatactaaatggaaatccatatgtttattcatcttgacttttagaaaggcagctcttgttgttgtctctcagcacctgtgcaatcagggatcctatgatctttcctaatatctggcaggccagatggttttttagatcaaaatgaaaaaagaaaaagatggggcagaggcggcagaaatgtgactgggtgatttgtagggttgaggagtgtgggattggtttgagattgttctagaattcagagccagggctaagaactgaccacagaggctcctcctgaaagacaccatcactctaagacccagcgagtatgcaaatccttccacttcccttagtcctttctatgaaggccttgactattcgatgttgcccctcctttctatcctttcccattatttttctccacatatcccagtttcctaccagatagtttcatttttctcatgtgtgaagtgaaggtaataataatatctggctcatattattactgtgagcataaggttggttaaaagaagcaaagcacttagaaccgtgcttggaacagtctttgtatggatagttgcttttatattactagcttttcttttttgtaaaatggacatgatagttccgggtaggtgataattataggcattaattgccatgaacataggcaaaataacacatagtaggtgcccagtgagtgccagttctctcgtatgaccactcttttctctgcaatattcacaccaatcctcttagagaattttcacacagagaaacaaagtggtttgttcaagattatgctgcaatcctgctgaagtctgtcttgtcttctgaaggggcttataaaacaaggcttaactcttgtggtgttttgctcctggtccattcacagtgctggatacaggaatgttgcgaaataaataattatactatatagtgacaaagctgatgctatggggccattaggtgttggaatgtgaaactggaagggagtcttggaattaaatctaggttgtattactacctccctacatgaacttgagcaatttccgtatctttctaggcctttgtttttctgtttgtataatgggagagggtcctttctggctctggtagcccttgtctgtctccatgcaatgggtaaatgggtagattaaagatgatcacacattctttgctactcttcgcattgacaggtgaaatctagctctttcccccttgaatctgggctgaccttattgacctgcttgaccaatagaatgtggtagaaatgatgttctgagacttctgaggctggggactaagaagccttgcagcttctgcctaggcacttagaacgctggatcttgggatggtcccttggtaagcccaggttccatgatgtgagaagcccaagccaaatggggagcccaagaaaaaatcctctatccagttgacagccccagctcaggtccagcatagccagtgtcaaccaccaatggtgccagtcctagccccagacaggtaataaaggaacccttctgcaaatgactccccagtcccagatgccccatctgtctttgatcagagacaaaccagctgcaccctccacatagtcctgattcacaaatctatagacaaaacaagagtgtgtgaagctactgagttttggggtagtttgttataaaacaatagaaagctggaaccaggaaagtgagctatgaactgatacttcaaaaagggttaaggaggacgcattgtgtttaccagattgtctggtgttgggttaatcaaaaggcttcctgtgctgggaaaaccagaaaaacataaaagaatggcattagtgaagtgcgtcagggggcagcagttacttagagatggtggtggaagtgtcctccatacgatgctgtgattaagtgcttacagttttctttgtttttattctctatcttgattaaaattttgcagtgtttatactgccacacagaataaatggacccatagcttacatttcaaactgtgccttgctgacatcattatgtttgtcagatttataacatttctaatatacaacaatttttcactcttggaacactgaaggggaacacaggctccctctcttttctgatgtttcattcactgttacttcctctatcactggtcaagggatatggtctccttggaaataactgaaaacaaaaataatagcataattatttatatattatttactgtatcaccctcctcatatgatcttttacctgttatcagtattttattgctattgtagcaaattactatgcaattggtggtttaaagtaacgcaaatttattatctcacagttctacaatttaaaagtctaacttgggtctcaatgggctaaaatttaggtgttggcagggttgcattcctttctggaggttccagaggtaagtctttctctttgcttttccagcttctaaacaccacttctcttccttagcatgtaactctcttcctccaacttcacagctggcaacgctgcctctctctaccccactcctctgctttcctgagcacactctgataattcaagatattctcgctcttttaaggtcagctaattagtcatcttaattccttacgcaaatttaaatcctggttctgtcatgaaaggtaacataccagtcacaggttctgggaattaggatgtggacatctttgcaggggccattattttgcctactacacatcttatggccatcctccaattggccaattacctatatgagaaacatattatccaaagggaaggttaccacagcagaaccagaaagctgagcaaaaatatgtcagattttttaaatcttgtgtttcaaaagttgaggtctagaaggtagagctattttagaaggtaaaataataatcatcattataatgacaataataaagcaatagaagcatctgtgatctgttagagaattaccttcccttgtatccacaaagaagtaaaggtcatctgagctggtggaagacaggaatgttggaagtcaaacaaagtaatctagaaaatgctaatgagtgttctaaaaggggtcccatcctctatccttaccaggctacgcccatgagtgtatgaaggggatgagggggtgcagaatatcaggtgggtttgagggctatgaaggcaaaggggttctgggcgtcacttgctatatagcacaggttgacagcaagcatggtgagtgatcctccccactgtgaaaacagccaactacagatcctttcctggcatgtctagatcaaaagagctctagacagctttcctcagatcctccaggtggaactgttggacatttctcaggccctctggaggctggaaaaactagctgacgcacagagccagctggccttaaatgaccttgtggtggaataaagtggatgaggcagcagctgtactacacacctgtgagtcaggtgggaatggagaggaaggagagtgatggacaagggccaagtgatgcagcaggtaccagattaaaaagtgatggcccagcatcaaacatgcccttagctcctaggccttacaggtacattggccctttgagctaaaatgttcagttaagaggtgggaggcagaaaaaaaactgaaattgactagagttaagtttccactaacaatggaacagaaatgaaatgaaattcagttacagaaacgtaatagaacattagatacgctgtgctcctaaatttgtgtggccccaaatatatccactacatacaaatatcagtaatgtggtctccttatctcactcataaatggtactttgtaaatcccaaatcattgccagttatattctttgagctctttcagttttttgtttttgtttttagaaaaatctgtaagtactgttgcttccttttgaaagattaagaaactgatgctaatgaagtcaacatagactccaaagctatggtcattctaatgcctaaatccaggctttagcccaattcactcagcccagcctcctttccatgattcttcaacgagaactcatctcagctcccagtgtgggaaagcaagccaaagtggccctggcagaaggactgatagtgagacatggtcttggtcctccaccctgccacctggtggtaagaccttggaaagtcactctgcttcctgagcctgtttccacattcctgagggaatctactgcccaggtttgttgtgaggatgagctcttagcttgtagacatgctttgagaatgctaaagtattctaaaaatataaggaattatcatgtaatacctgaaggaatgtcttagaaggtgagctatgagaagaagtttctctttacagacatgatggagagtctacagagaaatgaaagggatttaaaatctcagcataaacgtggtatttccctgtctattctgaagcacagagaggagcttgccttacatccattgaaccttgaagtagtggttttaaaattacatcctcaatctagagaggagggtctttgacaacttcatcagaccgttgaatcttctcttatcccctagggaatgaatgttctttctctttctctctcttttaatttttccagtttatatgaataaaagacaaagagagacaagcccaagctacacacacacacacacacacacacacacacacacacacacacacacactcctctgtatttgaggtttcattcctatgggatatctatcctaaaagagaaggagcttaattaatttgagaaaagagaactaatggaaaagaggaaagaggcagacaacttaatcctttgaaaaaggtcagccttacattctggacacaacacagaacatccttttgagctgtttgtccactggctgggtttcagacttcagcaaatcctcctctccccaactagcacttttccaatgtgctatatgaagggttaggtttcaatggtctgaggcagacagctgttgatgtatatcaatctagcatctacaactcctgttgccagcaccccagtttttcttgagagtctatgccttcccccatctcagggccatgcatttcaggtgtagctgcctcctggtgcaagctccaagcatggctgtctctgggatgagcccagttaatccccctgaccagcaattggtgcagggataaatgggcatgagaaccaagttggcacaatgagaaggaatctggtgacagtagttggaggtactaggaaagaagtgtttttgtcctgtaggacttgcatccagcctgcagctggcccaagaatggcacagtgctaaggaaagcagagctaagataaggagggggattccaatgacattgcttgagtccttcaatccaattttctccagacttccacttaagccaatgcatttccttcttctttttttttttttttttgcctatactagtttgagtttagtttctatcacttgtaatcctgagaattctaatcactaaaatttctaattgcccattcacatctgaagagctattaatctttgagtctcagatatagtttcattgcattatttcattctagaagcttcttcgtattgatctcctgacctttgtctgtttctcagctggtgtgtagctgcactaagggccaagtgtgtgttctgtctcccttgggtcttgttcagagagcctagtccagagcaggattcctatccctggttctatccttcccttcttctttcttttttctttatttactgagatgggtacttctggggtgttgagccgaatcaacagattccctgggttctccctcagttttttaagaaacataaactgaaaaaccagtctgtgctataacgtgtcacaggtgacttaataaagctaagtacagcatacagtaaagatactgtatggaaaagagggtcacctgcggggagggaaaaggcttcataaaggagatgtctctggaaagatgttcacttgtttgcttcatagacttcgaaagcaattctttctaggcagagagaaggtacaagaaaaggttctgaggcatgaaacatgcaggcaagttcatagaactccatctaatcagctccattaggctgtagtgtagattgaaatgaagcgataagagatgtggctggagaaactgaaaagggaccacagaaagaagagcattgaatgccaggctgagtttagcctatgtggcaatgtttcccaagtgtattttcaagataccccaacacacacaaatacacacacacacacacacacacacacacacacacatacacgttaaaaagtcaggctcccgggacctaatctcctctctagaataaaagcttctagaggtagaaccctgtatcttaggtcattcttataaaaccatcagttttggcacacccttctaaagcaacaggaaccctcccgcatcttcttgtgtgaccttgtcccacgctagatactaaaattccaagcaaacaaggctgcctctcccttccttcatgtctttgcttggctgtctccgctctttccctaatgtaagttgactcatcttttgaagccaaagccaaagccaaaagccaacgtcccaaggaagccttctacgaaactgaggtcccagctgaaactttctcttccggaccacaccaaagcacctgtccatactagttacacctcattgacatcccgcctactattgtattcacagaggtaaggcatgccctgtcttactctcaaatggactgtaagcttctgaaggtcagaagttctctaagacctattgtgtggtgggcacttaagttataatatcttgtttcattcttccaacaattccaagaggtaggtttaatgatctcactttacaggtgaggaaaccaaggtaggctggcatactgaaggccgcagaggcagataagggtagtgtggatatgatcctccttaccagcgttccctcgcagggcagggcttctagcaggtggccttagcccctgggccactgccatgttcccgggccaatgggcacttaccacacatcccgaggaatccacctgccggtcagacacacacttgaagttgcgagtgcagcccccattgttccgagagcagtcacgaactggcccgaaggaagacagcaggtcattgatggtttcaaagtatgtggacagcatcgcttcttcccttggagagaaaggggatggttaaaccccagagacatttggatccttagattaaaaaaataataatgtgaattcattacatttgaaaccataacttacttataatcaggaaaacaataataatcaatattataaaaaggaaacaacaacaggtataccatcatatgacacggtgcttgtcaagttgtgatacagagaaatggacctagaactctatactctttattttattaatacttatgattcttggaggtagtcatgagatgtgcactttaccgtaagggaactaggcttagcaaggtgaagtatcttgctgaaggccagcagcttacaatgtgaccgaagtgaagtttgtattaacttccagctgagtccaaagagaaggctcttctcactgcctaactcttagcttgcatcctacctgtttctacagatttcagagctccctatagcaactctgcaattgggcacatccctattattccaactttgtgaatataaaattgaaaccatgaaagattgtgggactgactccaaatcccacagtctataaatagcagagccaagacacaaacgcaggagtctgaccctccagggccctagatccttatttttcagactattgtgtataagtcactccatcaagactatcagcaacagttgttggaaaggtcatgggattccagggaaatacgtgattcctcccaaatgaggttctcaaaagataagactagacttgataccataatccatggatctgccaacattttatgagatggaattctctacaatggaggatacagatgggagcctctgatgctgtcttctgcagaaagggcccgaaataagagatacatttgctctggggtatatgattcccatacttacaggagattttaaagaagcaccatgggcagtgagaagcggcacatatccttccctggtctgtgcctcatgaggcccagagctgtgaagcaagggaaatgcctgcagccacacatgaagcaggaagaggctagcaaacactagagggggtgtctctgcaccatcttgcataccttctcccattcttctccacctcaggcttggaccaggtttgaaactcctaattcatttcctgcctccagtcttatcccttctgtcccatctttcatactgactgtcagtgaacttggtaaatcccagctctaattagatactcctctgatcaatagcttcccagtacttagagaagaaatataaattagcttctctggcattcggacttcataatcttgcccccagttacctgtccagccacatttaccctctcctcacatctctatccactaggcacaggcctcgtctcattccctgaacacagaatctctgaaaacaggttctaaactggaaagttacatgcaggaggtttattgccaagccctcttgggagatgcatctaaagatggtgaggaagggctgggcatagtggctcatgcttgtaatctcagcactttgggaggcctaggaaggaggcttgattgagcccaggagttcaagaccagcttagaaaatgaggcaaaaccctgtctctacaaacattttttaaattaccagggtttagaggagcctgcctgtggtcccagctactcgggaggctgaggtgagaggatctcttgagctacagtgagccatgatcaaaacactgtctcaaaaaaaaaaaaaaaaaaaaaaaaaaaaaaaaaggcaagcgaagaaggcaggatttggtaaagagagagactgatctacagtgcgggtctaaagtatcagttgttcctgcagggagctctggagctgagaaggccctttatggatgtcctgaattaaagcaaggaatccaggcctttgcatccccacagtagccagtcattggtggggctgctgtctggaatgggatatactaggataaaccagttccctgaggctgaaggcaatgcctagtcactgacagccacagctggtgggtgggtgggctggccctgaagaggggatctgtgtgtggtacctgcaggcacctctctcaatcccaaatcatgctcttccttctgcctgggatgcccatttccaaatgcttacgtgaagaaatcctaagaatctttgaaaactcttcatattcattcattcattcatttattcattgtacaagcttactgagtgtttaccatataccaggcacaatgctaggtgctggggatacagcagtgacatcaggcaagatcctgactcccaatctccacagtagctttatgttaccgcctttgtgaaaccttctctgttaattccccctactagaattaattccttttccctgtgagcatagtggctaaatcttttaacttattgatcttaattatcagcttcacagtctcccagagagactataagcttttaaaggaaaaggctcaagatttattcatttctctttagtccccagcacagtctggaaggaaagtgtgctaggtaaacattttcaaatgaaacacagaaaacacccaaaggcttagacgcagtcttcaccaatgagtacttttactaagaacctcctcagcagggcactcctctctgtctccccaactctgggtccccattccaaatcctttgtgttcagggatgcagcacagggacaaaggagaagggtgaggtgctacaggattatcccttgcttcctaactttgtagggagtgaggtgacaggtttatgggaggaaagaattaatagttcctgaaatgaagctctggggagacttgccacttttgaatcatgaagagagttgaggatcctgggaagacattaagcctattaaaatattaataccctagaagggagaagaagaaacagaaagtaagaggaggagataaggcagagggaccaggctgggcgtggtggctcacacctgtaatcccagcactttgggaggcctagatgggctaggtcaggagatgaggactatcctggctaacatggtgaaacctcgtctctactaacaatatagtagccaggtgtggggcatgctcctgtaatcccagttactcgggaggctgaggcaggagaattgcttgaacccaggaggcagaggttgcagtgagccgagatcgtgccacggcactctagcctaggtgacacagcgagactccgtctcaaaaaaaaaaaaaaaaaaaaagacagagggacctgagaaagtgagagaacaagagataaacaggtagagaaactgctgagaaggaaagaagagacacagagaggcagaaacacatatagccacctggaaacagataaagggatctaaaaggtatagatggacagacagagagacagagagttatagagggacacaggtcatagagacagacaggaaaagaaaggcaaatagaggagagaaaggatgtgaaaagataaaaatgaaaagatagaattggaaaaagaaagcaaagagagaaacagaggcataagaaacagatgaaaagaggaggcatactcaaggtaaacagaacaaatgtgtaagtgtgccgaggagagggagagaaggtgggagggagagtgagaaaagagagcaggaggagacaaatgcagaaagacagaatgaaagggaagagaaagacactgagtaagaaagaaaacacacccatctctactaaaaatacaaaaaattagctgggcgtggtggcgggtgcctgtagtcccagctacttgggaggctgaggcaggataatggcgtgaacccgggaggcggagcttgcagtgagccaagatcgcgccactgcactccagcctgggcgacagagcgagactctgtctcaaaaaaaaaaaaaaaaaaaaaaaggaaagaaaacacagagccatggagagcagagacagacaacaacaaagaaacaaggaaagggaagtgaaaaacaagcaaaaacatgtcacctttctctggaagctagagacagttcaagctataaaaatacaaaagctgtccacttttaaaaggattgattctgcataaacatcagttacatgaggggaacattacttaaaacacaaagacctgacacaggggccgttactaagtcaagagaagtgattgtgtcaggctagggaatgaagaatctgagcgcaagacaggaaaaaaaagcttaaagcagacactggcgttttcttaactcaaagcagacactggcgttttcttaactcgggggctcaatccttcatctcacttgcggagcccagggtttagggtctgtgggatcttagagctgccccaatcttggggcggggagtgggaggcagcaaagagatgaatggaagagcactgggggcggaggcaggctggactgagacactgccctggggtatcaggataccagtgtgagaatcccagctttgccagcaatcaccaaaactaccaacatcctcttcattatttaggatttcctgggcacctgctatgtgttaagcatggtgcaaggttcccttcctgtaatattccctgtgattttcacaagagccctagaaatgacagttttatacccaatgtgcagctggagaaacaggggcttagggaagttatgtcacttgctccagttctcaatggcgtgatgcagtgaggccaggctgtgcactcgaatctgcctgacctcaagtcctgagttaaactttaacaacttaccctgtgtcttgggcaagtcagagccctcctaacagtaaggcccgtaagaatgtgtgttcaatctctctgtcttagcagaggaggacagaatgggcagagcctgagagttctttgtgtacctcccacagcctgattcctgggccatgcatgtggtccacaatagcctcaatccatgcaggaatagaaggggaaagcatagtgtttaagtttactagaagggccataacaagtaccatgaatcaggtgacttaaaacaacagaaatttattctctcgccattctgaaggccagaagtccaaaatcagggtttggtagagccctggtccctcagtaggctcaaggagagaatccttccttgcctcttcagagcctcccatggctcccagccatgcttagctttccttggctggcagtttcaggactcctgcctctgtccccatcatcatatggccttcttgcctgtgtgtctgtgtgtcctctcctttttttaaaatgacaccatttgggctgggtgcagtggcttacatctgtaatccctgggaagctgaggcaggtggatcacctgaggtcaggagttcgagaccagcctgaccaacatggtgaaaccctgtctctactaaaaatacaataattagcagggtgtggtggtgggtgcctgtaatcccagctactcgggaggctgaagcaggagaattgcttgaacctgggaggcagaggttgtagtgagccgagatcacagcattgcactccagcctgggcaacagagcaagactcctgtctcaaaaagaaagaaagaaaaaaaaatgacagcattagttgggtttagggtccaccttaatctgttataaccttttcttagttatatctgcaaaggccttgtttctaaataaggccacgttctgaatttctggtgaacacaaattttgggggacaaaattcatgcaattccacagggcacaggggaatgtgctcacattcgcatggtaggacagagccaggactaaataaaacacctcagtccttgattcttatcaaagtgttcctaatactgcactggctcttctcactctagacacttcatgtttcattgtggtccttacaaggtttgaaaaatcttagggaaaggatcatgatgaagtcactctccatattatctgtgcctttatttgggaggagaaaagaccaactttaattaaatacctaccacactccagcaaccgtgtagagggttttcaaccactctacagaacagagcttggcaaacttttctgtacagggctagatagtaaagatcttaggctttgcaggccatacagtctctgtcccaatcactcaactctgcttttgtaatacacaaacaatcatagacaatatgcaaaagaatgaatgtagctatgtttcaataaacctgtattaaagatgggtgtagtggctcatgcctgtaatctcagctctttgagagactgaggtgggaggatcgcttgagcccaggagttcaagaccagcctggacaacagagtgggatcccatttctataatttttttttttttttttaattagccaggtgtagtggtgtgtgcctgtagtaccagttactcaggaagctgaggtaggaggattgcttgagcctggcaagtttggggaggtgggggtcaaggatttcagtaagctgtgagcatgctactgcactccaacccatgtgacacagtgagaccctgtctcaaaaaaaataaaaaataaaaaatactgtatttacagaaagacacagccagataaattattttctgttttaggtgtgaaaaccctgaagtcagtgttggagttaggagttgaacccaggtaggtccaactccacattctttctcctacatgaatcttctgaaactcagccttctcatctgtaaaatgggaacaatatctgtctaattctcagctctgtagatgactatgaggatataataacatgatatagaaatgtgttttccaaactctaaaacctaatgcaaacttattcattgtttattcattcaataaatatctgagtacctgctgcatgccacatactgagctgattattattatggcttttctttggcctcccagcagctgtttctgttcctatataacccagacattgtgcaaaaggttccaaacatctctctatctctgacatacaaattattattatttttttctgttaatactggctccaaaacagagatagccagaccccaccagactgggtgagacagccatcccctaattacctgaccggtaaagtacaaatgcgtcacctggattccatttggctgagtcagcccaagcctgatgcagggtgagcattaggcagggtggctgggaacagatgctgacatggcctgctgttaataaataccaggaaaggtctgtgtcactcatagagagatgtgaatggatgatgccaagccaagacagtgacaagtccctcactgatgcagattaatcattctctggtaatagccgacaaccttgtttcctgagctacctgggaaggaggaacctaagacaatgtactgataaaaatcaagctcagggcaggcacggtgcctcacgcctgtaatcccagcacattgggaggccgagacagacagatcttgaggccaggagatcgagaccatcctggctaacatggttaaaccctgtctctactaaaaatacaaaaaattagctgggtgtggtggtgggcacctgtagtcccagctactcaggaagctgaggcaggagaatcgcttgaatcagggaggcagaggttgcagtgagccgagatcgtgccacggcactgcagcctgggcaacaaagcgagactccgtctcaaaataaataaataaataaaataaaataaaaaatccagctcagtttttttattttaaagaaagaacgctttgttgagatataattcacataccatatgatttacctatttaaagtgtacagtttaagcagggtacagtttaagtgatcaatatttaaatattttcatcaacccaaagagaaaccctgcctctatcataagtccctgcctacttcctcccaatgacccttgtgttgggaaaccactaatcttctgtctttatagatttactaactctgaacacttcatgtaaattaagttatacattatgtagccttttgtgactggctactttcagttagcatagtgttttcaaggttcatccatgtttcagcatgtatcactacttcattccttttgtattgccaaatgatattccattatatagatattccacattttattcctctatcattagttggtggacattttggttgtttccacttttcagttactatgactaatgctgctatgaacattcatacacaggtttttatgtagatacatgttttcatatattttgtggctccccctgccctgggatttagggagccttctcagcccctaatagcatgagccacagtgtagaacagtagataagagggcaagtttgtctggagtcagactgccctgaggaggaatcccagcttcactcagtatgagaccttgggcaagcctcttctttttgagacagagtctcactctctcacccaggctggagtgcagtggcgcgatcttggctcactgcaacctccgcctcccagttcaagcaattctcctgcctcatcattccaagtagctgggactacaggaatgtgctaccatgccagactaatttttgtatttttagtagagattgggtttcaccatgttggctaggctggttttgaacttctgacctcaggtaatccagagaccttgggcaagtctcttaaaccctgagcctcaattttctcatctgtaaaatggggatattaatacctaactagcagaggtagcatgagtgatagattagggagcaaatgtgtcaaatgccaggcacacagtaagtgcctaacagctggtaataagtggtatcatctgaaagtccctcaaagttgcaagaaccatgccttgagaatgttgagaagctcaatgtaggagaagggatgaaagatctgagaccccacatggtccatttactcagttaaaaatgtttctttggtgctaggcttgttctgggtactcggctgggttcctgggagacacaggaatggatgtaacagagcttgtgctaggcaggaggaaaaacactaagctagcaagataagtgaggccacaggaccacaaagatgactctctctctcttgccagaccttggaagtaggagctcagagaaggctttttggaggaggtaatgttgagcctgagacataaaggatgggtggaaattaggtaaagggggataaatagagtgggttaaagaaattctagggagaaggaaagaatatgctaaggcctagaggtaggagatagaataccctgattgaggggcttcaagagatgcagaaaagctggactgtcaaggaggaggtgagatatggcaaaggctgaagcagaaggagtgccaggagccaggctagagaagattcctgtgtgccaggccatggtgattctggactttaccctggaagctatggactgccacccaaaggttaaaaagcagatcctgcttttatttagagtaatatcatagatgaatagtttacacaaatccttatggcaataatagttaatgctgattgtgcattcataatatgccaataaatggtttaagcactacatgtatcaactcacttaatcctcccccaaaacacaatgatgtaaatgatacatccccatttcataggagaaagaaactcaggcaccattttgaggctgttttgagacctgttaaggataatgtaggtaaagcattaggacagtgcctggcacatggtgactgctttataaggatttcttgaaaaacagcttccaggggagggatagggtgaggtggcacaagccacaggtaggtagatttgagcttttccaaagccagagacattcagcaagggaacactgtcttccaagttactgctccagccttcaggaatgcatactgaggaggcatggccattttcctgggatagttgtggcgggagtcaggcctccagtgcagagggtgtacaatatcatggtgataacaacattcacatgggctaattatctactgagaatttatgacatgagaactttggcttaacatagattatctcatttaataattgcctatgggattgtgctattatccctgttgatatggtttggctgtgtgtccccacccaaatgtcatgttgaattgtaatcctcaatgttggaggaggagccaggtgggaggtgattggatcatggcagagtggggaggcagtggacttccccattactgttctcgtgatagtgagtgaattctcacgagatctggttgtgtaaaagtgtgtagcacttgctccttcactgtcttcctgctgttccagccatgtaggacatgtctgctcccccttccccttctatcatgttgtaagtttcctgaggcctccccagctatgcttcctgtacagactgtggaacactgacccaatgaaacctcttatctttataaattacccagtctcaggtagttctttatagcaatgcagaaacaaacgaatgcctctgttttttcaatttgaaaagaaatgtacacactcagatgcaggacttggcatttacagaggtgagaggactggcagtgagtcctagtgacagagctgggttccaccctgggtgtatctgacttcggactctttagtgtcctgcctttctctttaagaagtctttccacccagagattctgggactggtgttttagctgacacttaacattctccttcctctagcaattatggtttgcactaatttaggttgatatatatatatattgctgttcagagtggtctcataacttcctgggagtgtcttgtgcttctgagtagcttgttagcttcctgcatgcctagagtcctcctcggtcacatcccttagtgcactgggcatgctgcagctgttcgctgaataagggcaggtgttgaaggaagagaagaagggcacaataaggcccatcagctgtgcagtctttagaacaaagagaaaatgattgtaatgtctgttgtccatctgtgtgatggaggcaataatattcaactcacagaattgtgggtcagaattcaaagagttaaaagatatgaaagtctcttatcaccaggctcaaacaaataaagatcctcaataaagagctgttgtgttttggaaatgagtttgtgcatttcacagatattgacccagcactcacccctggagttggaggttgggtatagacacagcctcgttttattgtacctcactttattgctcattgcagatattatttcttaaagattgaaggtcggtggctaccctgtgtcaagagagtctatcagtgccatttttccaacagaatgtgctcacttcatgtctatgcatcagattttggtagttctcacaatatttcaaaattgtgttattattatatcgtttatggtttggggagccctcattgcgctcatataaagcggccaacttacttggtaaatataaggcctccctgtttgctgagacaccacaatattgaaatcaggcctattaataaccctacaatttcctctaagtgttcaaatgcaaggaaatgtcacacatctctcactttaaatcataagctagaaatgattaagtttagtgaggaaggtatgtggaaagccaagactgatgaaaagctgggcctcttgcaccagttaggcaagatgtgaatgcaaagaaaaagttcttaaaggaaattagaagtgctacttctgtgaacacacaaatgataagaaagtgaaacagctttatttctgttatggagaatgttttagaggtgtggataaattaaaccagctacaatattcccttaaacccaaactaggacaaggtcctaattctcttcaattctatgaaggctgagagaggtgaggaagctgtggaaggaaagtttaagcagagattgattcataagttttaagaaaaggagccatctctgtatcataaaagtgcaaggagaagcagcaagtgctgatatattaatagaagctgcagcaagttatcaaaaacatctagttaacataattaatgaaggtgactatgtccaacaaccgattttcaatgtagatgaaacagccttgtattggaagaagatgccatctaggtctttcattgctagagaggagaagcctggcttcaaaaattcaaaggacaggctgtctctctcattaggggttaatgcagctgttgaagccaatactagtttaccattataaaagccctagggcctttaagaattatgctaaatctactctgcctgtgctctataaatagaacagcaaagcctgaatgacagcacatctgtttacagcatggtttactgaatattttaagcccactgttgagaactcctgctcagaaaaatgagctgtgatggagatgcataagaggttaatgttgttttcatgcattctaacacagcatccttttttgcagcccatgcatgaagaagtaatttcaagtcttattatttaagaaatacattttgtaaggttatagttttcatagatagtgatttttctgatggatctgggtaaaataaattaaaaactttccagaaaggattctccatcttagatgccatgagaaaaatttctgatttatgagaggaggtcaaaatatcaatattagcacgagtttggaagaagttgattccaaccctcatgaatgactttgaggggttcaaggcttcagtggaggtaataattacagatgtgaaaattgcaagagaactagatttagaggtggaggttgaagatgtgactgaattgctgcaatctcatgataaaactaatgagaagttgcttcttgtggaggagcaaagaaaagtggtttcttgagttgtaaactactcgtggtgaagatgctgtgaatactgttgaaataagaacaaaagatttaaaatattacataaacttgcttgataaagcagtggcagggttggagtaaattgaaaaaattcactttcaaaaagttctgtgggtaaaatgctatcagactacatcacatcctacagcaaaatcttttgtgaaaggaagaatcagttgttacaacaaacttcactgttgtcttattttaagaaattgccacagccacttcagccttcagtaactaccaccctgatcagtgagcagctgtcaacactgaagcaataccctgcaccagcaaaatgattatggctcactgaagattcagatgaccattagcttttttttaagcaataaaatatttcttaattaaggtatgtacattattttttaaacatgatgcaattgtacacttaataaactatagagtaaaaaataacttttatatgcactaggaaacaaaagtatttgtgcaattcactttattgtgatatttgctttattacggtgttctggtacctaacacacaatatctctgaggtgtgcctgtatacagaaaagagcaaaacaaacatgtgctttgtccctctggggcttacagttgttgggacaagtaagttcctcttcaaagactcaaatttctggtcataaattgtaaaccaaacctatcccctccttttttcacaaatcgcacatttaccctatttggaaaagtttaagtcttagccaacgggatctgcttagattgtgcggtctaaccccagccaataggggaaggacacagaaacaggaactgcattagggttaaaaaccccttccctcctttgttaggtgtgctcttgctattgtaaccagtgcaagcagcacccttctgcagaagtaaatgtgccttgctgagaaattttctatctaagtgtgggtttttttttggctatgctgagcacttgtttccaacacaggtagttattggaacagtcactcaacaaataactgccttaatatcaatatgtgtgtctatatctatggctatagctatgtctatgttatatctgtatctatgtgtatatatctatagctatacatctatgcctatgcccctatctatacctaaatttataattacaaactgtgatagatgctttaaaaatactgaatacagtaagatcatatggcagaggggccaatctaatctagggatttggggatgggagtgtggagtgaggcagatttccctggagagtatgagaccctgaaaccaaaccagcctgtggtatggtgaggtttcatcacacccaggctgtccccaggagagctgggatgatgtgtatcctccattcccacccccaccatgcacagtgatcatggagtccatcattcctctggcaaaaaaagccatcttctcctcctgtacttgttctgaccatttagtcatagaaattctcctcttcacttaaacacatttacaagaaaagaacaaacaatcccattaaaaagtaggcaaatgacatgaacagacacttcttaaaagaagacattcatgtggccaacaaacatatgaaaaaaagctcaacatcactgattgttatagaaatgcaaatcaaaaccacaatgggataccatctcacgccagtctgaatggcagtttttaaaaagtcaagaaacaacagatgctggtgaagctgtggacaaataggaacacttttacactgttggagggaatgtaaattagttcatccattgtgtaagacagtatggcaattcctcaaggattctagaactagaaacatcatttgaccccctgttactgggtatatacccaaaggaatatcagcctttccattataaagatacatggcatgtgtatgttcattgcagcactattcacaatagcaaaaacatgaaatcaacccaaatgcccgtcatgacagactggataaagaaaatgtggtacatatacaccatggaatactatgcagccataaaaaggaaggtcatgtcctttgcaggggcacagttggaggtggaagccattatcctcagcaaactaatgcaggaacagaaaaccaaacactgcatgttctcacttataaatgggagctgaacaacgagaacacatggacacagggaggggaacaacacacactggggcctatcagggggctgggggagagacagcattagcataaatagctaatacatgtggggcttaatacctaggtgatgggttgataggtgcagcaaaacactatggcacacatttacctatgcaacaaacctgcatgtcctgtacatgtattccagaacttaaacttatttttttaaaaaaagaaattctcctcttcacccacccctctttctcctaccctttgcaaatctcatccttattttgaaaaagaaaaaaaagtttcagtggcaaatgctgaagcttgaggattatttattcataaagtacccacatggagtcactgagagctcctccaagctctcatctcaaacagaagaggctcattaagatgggaagtcctggggtctcaggtgtgattgctcagaaagccagcaccttcccctggttcagggtgtgccctgctgctcaggagcctgagagactctggtgatctggatggcagagggggttgccgtgagccaggagagcccagcattagacagtaaatggggctgtgacctctagaaggaagagcactggcctggaggctcaggtatggtatcagagtccagctcagcctccctctgctgtgtgtacctgggtgaccctccaccctctatgggcctcagattctacatttctacaatgatggggtgatctctaagggctcttccagctccaatttctaataacataatgtggcttcccaaaaagactgacaactgcttccagttgtcagtttcactttcagaaataaggtgaaaatgcaagactggagagagacagagacagacagacagacagacagacagacagacagacagacagagaattcattgttttgaacctgaggaaatcaagggactgtgttattatgaggaagcagctctgggctcaaactctgctgctcatttgctgagaaaaccaacaacttattcaacctctcttgagtctcagtttcctcatacataaatcatagattataataccgaattcttagttttcatgagaattacattagataataaaacttccatgaaggcatgggttctgccatgctcactgaagtctagtgccttaaacagagggtctggaacactgtgcaggcaacccaatttgtttcggacaaatgaatgaataaaaacacacgtgaaacactctgcaaagcactgagcccataacgaagatcaatacacttgcttgtattgttacagtaattgttactaacaatagcctgcttttcaccaatcctaaaagttactcaagccctgagaacagggattcttaacttggtgtcaagacttgttttccaatctgatgaagcctatgaagcctatggaccacaacttagagttatgtttttatgtggataaaatcaaatgaaaaggcattctaaaataaaccatttatcaaaatgtatttaaaaatcaattgtaacataatctacatgttcctttattgacatattaagtaaaaatatctagtagcagatataataataaccataaattcaaagcaataatgagccaaaaatatattttaagacatttacaacaaatgcaatatgatataaaactataagtaatttccactggtgacaaagtcacaggtactgctaacacacctatgtttgttgcctatgtttgtaatagaaagaaatgttaaatttcaatgagtggctggcaaaagtaaagatgtatgattttcccatgaaatttcatgaaactccagcatagaccccagattaagagctgctgccaacaatgacactttattggaaaaagcttttctctgtatagctgtcactgtgaatataatcagaagcttgggtcctgataggaagacaggaaattaaaactcaactatcatcacaccaaaataattctttcctgaaggggcatatgtgatgtggtgaattaacagacttgggcttcagaaaataaataaataaataagtaaataaacaaaagctttcaggggtttgcccttgcgcaaatgacctcccacctcagaacttcagtttcctcatctgtgaacaagttgtggtaatgtttcctccaagggtggctggagaatggggtaaaatacataagataatgtcccttgtgcaaatatgcaaatactggctcttctgtgtctcccttcctgttccttctagggcaaaagaagtttattgcagccatccatggctgccataggtgccatgatggggatgaatttctgaatttcttaaggacttactaggttctaactccatgctagatacttggcactcacaggtgctgagacatgacccccgccttcaagaagggcacaagctggggcagagatagcaagtaaaaatttacatggtgaagctgagtagacacatattatagacacataaagacgtcatgaggtcctcaaaatgaagcgatgacttttcctgggctggctagagaaggctttctagaagaggtagccacacatggatcttgaagaaagatgagaacatgaggaggagaaaaggaagaaaatagaaagacaggatggctgctagacgacagcacaaacagagtcacagaatgtggaagaggaggaggaggaaggtgtgttgcataaatacccatacccaatgagcccattattaaagtgtgggatgggtgggagaaaagggagctcaccaggcccagtcacgtgtgttttatagacattttctagttcacaaggtggatctcattacctcattttgcagataaagaaactgagtcatttaaaagtcctataatttcctagtggagccctagtaggaatgcaactgcctctgactctgaagtccatattcttctcccagaatgccacttgttgaatttgagttggaatcccagttttgctttgtatctcactgtgtgacctcttgaaggtcactagtctctctgacttcagcttccttatttgtcaaatggagactatagcacctacctctcaggactgatattaaaacaaaaatgataagccacttaaagcaccacatgcattgctgggcataaagcaaaaatccaaccagtgtaaattcccttttactgcacttctccatttgcacctggagtggccactgcctttgcatggttttgacaggctagtggaaagtgcaatttcccaaaagatcccagcttatgtaaaacacaaggcacctcaattgcctacaaagagttggtttccgtaatggaaatcataggcagcaacaggccgtgttcaatctgtcagctacttgcaaaaattttagtagtagacagtgagttatggaaattaaatagtagtaatttcatttgctggataagaactatttgatgtttcgaagcatcaagaatatttgtagcacaacttaatgaatggagtttttatgtggtgaaaatcacaaggtaattacccagtgatcatcaataattgtaaaattgttaagcactcagtgcctcaagtgatgattcctaatttcttttggaacaataaaagaattatccatctatccatccatccatccatccacccatccattcatcactccatttattattacaaatatatttattaagtacctgctctttctggccctgcactcttagctgtcagatacgagtaagccatagcttctgtacccaacaaggccaacagcagtcttgcaaagtagaaaagacatggcagaaagactattagagaggtctgtaggagctcagaaagggaagaggttacttccagtttgagttcaagagagtgagtgaaagttactgtatggatttcaaaagacttcagtctttttgtatctgaaattttgaaccatgtgattaagtatacttgttaaaacataaataaatatgttattgtttcaaagatcagtgatgacactgagaaagaaggaaaaggtgacaacagtggaggcagaaaaggaggaggaggagaggtagagggtcatggactgagaacagtcattatgtttgagctagtgtcatgagtacggaggcagaaaacaaaaaactgggagactgcaatcaaagtgaggtggtggaaatgaaaatcttgagtgtaaactattctccaaaagcttgccaatgtcttcatttgtatttatttgacaagaagatattggcagaccatagtggctcactcctatgatcccagcactctgggaggccaaggcaggaggattgcttaagcccaggagttcaaggctacagtgagctatgattgcgccactgcactgaagcctgggtgacagacagagaccttgactcttaaaaaaaaaaaaaagtattcattttcatcaatcaagttggcaaatattcttgccaaatgataattctcagtgccgaagggggtgtagtgaaatgctattttcgtattccactgtgggagtataacttgccaacatttatggaaagcaatctggcaaaatgtatcaaaactcgaagtgttcgtacacgttgaccaagtgatcacagtaatcagttctagaggaaaaatgagcaatgcagatgatgacatatgcacaatgatgttcgtcacagcattgtttataatggggcaaaatgaaaatgttctacatatctaacagtgaggaaatgatcatcaacatatggttcattcccacagtaggatgtcctgtgaaagtttaaaatcatgatttctatgtataactgatgatatggaaaaagtttgttataatattaatttttaaaaggcaagaaaaattatatcgatataaacacatgaatgcacatgcccatataatccaaaaacagatattttaaggaagaggtagcatttaactgggttggatgtgtggagacagcagtgagactacatggtggacagcccttatatttgtttatataatatccatgtccctttcttctgataacagcacctccattttgggtttgcggaaattcacatccctctttcctcacacacacacactggatacattcttgtagatttttgagttaaggtgtcttgttttcctctgacttactgctgagcaggtgaactgacaattaagccaaataggtatttactcttgggaatctgaaactaccccctcggccttcctaagtggcatggaggttgcagatgcagaaatcaattgttcataaactatccacgctcttctaactcttgaaagttcttccaggtagcccatgaaggtaggcctacttggatttgcagactgatgcaggccaggcacaggagatttctagacagagcaatggcataaatagaactaccatctacaagccattatgcaacactttcattcagagcttctggatttgggacagcatgtcctgagttttgtcagtagaacagacaaagcttcaggcttttgagaacagtgttgagtgaagatgctgagtttcatgtagccagaccagaagggatgctagtcttgtggcatctgaaggagacagtagaagacaaaaggcagcagaagaggggcttccaccttgccttgtctccacccaggagagcatgaggcaagtagaaggtaaagatgaagatcaagcggagtgtgcctagagttcatcgttaatagagatgcttggtgaattccatcccacagccagacaggcaggcttctagacagtctagaagcccatgtctcttccagatctaaacttggggacttatgctgcctagcaggccatggaacacaggagaaagccatgggacctggattccaagagaaggggattcaagtccttctctgctgctagtgtgagaggacttggatagtcacttcctgtgatagtttgttagggctgccttagcagaataccataggctgggtggaggctagaagtccaaaattaagacatcagtagagttggctgtaatctgaggtctcactccttggcctgtagatttttcttttccctttgtcttcacatggtctttcctctgtgcctatgtgttaatctcttcttttaggaataccagcccatggtattcctctttgaataccagaggaatctcttgattcctctggggaatctcttgaaccccagacgcagaggttgcagtgggccaagatcgtgccactgcactccagcctgggtgacagagcaaaactccatctcaaacaaaacctcctcttctggtagtttgctagccatctttggcgtttttggcttgtagacacatcactctgatctctgccttgatgtctgtatgacattctccctgtgtgcatgtcaatctccaaatatccgccccccccccacccacttttttttttttttgagacggagtcgcactctttcacccaggccagactgcagtggcgctatcttggctcactgcaagctccgcctcctgggttcatgccattctcctgcctcagcctcctgagtagctgggattacaggcgcccgccactgtgcccggctaattttttgtatttttagtagagacagggtttcacaaatttcccctttttataaggacaacagtcatatgggattagagaccaccacatttaaccttaattgcctctttaatgaccttatttccaccagaggctggaaagggtgtgtgtatggtcatgggtgaagagaggttagttaatgggtataaatatatagaaggaataaagtctcatgttcaattagctagaagagaagactggaaatgtcccaacacatacaaatgaaaattactcaaggtgatggatataataaataccctgacttgatcattccacatcctttacatgtaacaaaatattaaaggtaccccatgaataagtataaatactatgtatcaataaaaaaagaccttatctcaacggagcacggagcacagtggctcatgcctataatcccagcactttgggaagctgaggtgggtggatcacctgaggtcaagagttggaggccagcctggccaacatggcaaaacctcgtctctactaaaaatacaaaaattagccaggcgaggtggcatgcacctgtaatcccagctacttgggaggctgaggcaggggaatctcttgaaccccagacgcagaggttgcagtgggccaagatcatgccactgcactccagcctgggtgacagagcaaaactccatctcaaacaaaacaaaacaaaacaaacaaacaaaaaaaaacctcttatctctaaatagtcactttctgaggtactaggggttaggacttaacacacaaattgtgaggtgacacagttcagcccatattacttctcttttcagagcctcaatttctgtatgttcaataaggctgtttgctcattcatttcaaagcatgtccatccattcatttactcactcattcattcattcaatcatttagcaaatacctattgaatgccaggtgttatcaccaggtttaggtttatgcaggaaaatatgaaaaaaatagtcttttctttatgtcaaaggggcaggtgggctttctgtgctactatttagagaaggttggggagaagacctcaggactgatcctcttgcctctacttcttaagagtctgtgaggacctacaacatcaggcagcaaaaaagcctagtgctggccatagacccactgtcagacagatctacagtcccaggaaacatgctattatctgtccacaggtctggtttgctctgtcagtttcattttagacaaggccactaattggcctgcctgccttgccagtgggaaaagaaatagtgtggggaaggaattggtagagacagtgctggtctgttaagtacctcaaaggcagactgcccaagcaatgtgggaagactgattcctcctgcaattgtttcttttttctttctttcttttctttttcttgaaacagggtcttgctccgttgcccaggtttcactgcagtggtgcgatcacacactgaaggctctatttcttagtttcaagcaatcctcctacctcggcctctggaatagctgggactacaggcatgtgccactacacctggctaatgttgttgttgttgagatgggttttactatgttgtccaggctggtcttgaagtcctggcttcaagtgatcctcccactcagccttccctaagtgctgagattacaggtgtgacctactatgcccgacttgctttttgttgttgttttgttttgttttttagtggggatagaacttggcatttcagaaataaaagaatattttttttattgagcatctattacatgataggtactgctctaggtgcagcaaaggcagcagagtattaaagagagtcctttccctctcatgcaggggagacagataacaaaccaatgaacaaggattaaagacttatgtggtttaagagttaaatattaacatgatgggagcttgggggagctgtggtggggcatgctgatttagtaaggaggtcagggatggccttcttgataagatcatcatggtgtaggctcatggacataatcaaatgggaatacgaatgcagtgattagcacagtgtctgatgtgaaacaagtgctcaataaatttctgctgtcgatgttattgtgaataatgtgctaagttccttatttgaatatagggacattatgcctatttcataaggttgttggatagattaaatttggaaaagcatataaataaacttacatggcaaattcaacaatggctgagtactagctaggtgagacagccaggggagacagacataaacacacatagaaatacatgcaagcacatcgtataaagtcagagcagggtaagtgaaagaaaagaagtcagggactcagggactgagatggagatgcctggggagaagggacaagctgtttaggatgggaggggtgcaggatcccccgaggagaggcttttggacagagggagaaagggaattctggaaacaaccagcctaggaaaaaaacgtgttacaagcagagagagcagcaggtgcaaaggcccaggggcagggatgggggtggcccttcaagaaccagcaggggccaggtcacagatagtctcagaggtgacagtaagaattttgagttttactataggccaagagatacacaatgcacaagtgttaaggagttttgagcaaagactgcaatgatgtaatttactttgtattgttgttgtttcgatttttttgagacagggtctcactctgccacccagggtggagtgcaatggcatgatcttggctcactgcagcttctatctcctgggctcaggtgatcctcccacctcagcctcccaagaagctgggactacaggcccgtaccaccacatccagctaagttttatattttttttagagatgaggtttcaccatgttgcccaggctggtctcgaactcctgagctcaagggatccacctacctcggtttctcaaaatgctgggataacaggcgtgagccactgtgcccagccccaatgtgatttacatcttaaaggataaatctgatcgattcattcaggtaaaatttcgtattgataatatatatttttcatatatcataagatcagcagtaacttatataaagtgtctgaccctcaatctaaaataaatgtattcattagacctggcatggtgggtggctcatggctacaatctcaacagattgggaggctgaggtgggaggatcgcttgatcctgggagggtcaaggctgcagtgacccattgctcataccactgcactccagcctgagtgacacaatgagaccttgtctcaagaaaaaaaaccaaaaatcaaatgtattcattcatgactactttgtgtaggcatgccagatacagcagtgtacatacaggcagtgacaacatattgttttctggtggatcttctgatggttttattgaaacagtgtagatgctcaataaatattctcatttgatatgaaactatatattatgatattattcatatttttatcactcttgctctaaaagtgatagtaagccttctccagaggttctttcttttgtttgtttgtttgtttttgagacagagtcttgctctgtcacccaggctggaatgcagtggtgcaatctcggctcactgcaacctccacctcccaggttcaagcaagtctcatgcctcagccttctgagtagctagaattacaggcacgcgccaccacacccagctaatttttgtaattaaaaaaaaaaataagttctggaatacatgtgcaggacatgtaggtttgttacataggtaaatgtgtgtcatggtggtttgctgcacctatcaacccatcacctaggtattaagccccgattgtattagctatttatcctgatgctctccctccccacaatcccccctcaaggtcccagtgttgttcctctccctgtgtccatgtgttctcattgttcagctcccacttatatgtgagaatatgaggtgtttggttttctgttcctgtgttagtttgctaaggataatggcttccagctccatccacgtccctgaaaaggatttagtctcattcctttaaaacacccttaatttttgtatttttagtagagacagggttttgccattttggccaggctggtcttgaactcctggcctcaactgatccaccagacttggcctcccaaagtgctgggattacagatgtgagccattctgcttgggctggaggctcattcttgaggaagagaaggaagcaaaagaaaaaaaagaagaggaaaaaagaaggcaagagggagcagggaactgccatgtctcaccactatctctctggatatgtggatgtggccttcctctcatatgcctatttggtggacttttattcatgtctcagggcccagctgaattatcacctcctccatgaagttagaagccctcccttcaacacaggcacagcagtgaaattgctgccgctggcctgttcacctccctggcttccgggtccatctctaatgaggccaatcccactgcataggagtatgctgtgtgtttgctcaccaggttgatgattctcattttttttttgtgcatcctcaggaattagaactggttttcatgtgtgcctggtataataaatgtttagcgcctggtgcagtggtggctcatgcctgtaatcctagcactttgtgaggccgaggcagaaggatcacttgagccaaggagtttaagaccagcctgggcaacatagcaagaccttgtctctacacacacacacacacacacacacacacacacacacacacacacacacacaaataagaaaattagccagatgtggtggcacatgcctgtagtcccagatacttggaaggctggggtaggaggatcacttgagcttaggacttggcagctgcagtgagctataatcttgccactgctctccagcctaggcaacaaagcaagactgtctcaaaaaaatgaaaaataagaaagtttaggaaagaaaggaagaaagaaagagaggagggaggaaaaggaaactaattctctcctccttatttttccagataatgctaaagctcatttcaaccagcaagtgctgagtttattgatcaacatttcagaggtattgaactgagtttgtattgacagaaataactggcaaccaggcagggggagcgagaaatgtgctgacagtcagcaaatcatacgcctggtattggagagcctgtctatgccaaaggggacaatcattaatttcctattccttcatagttacattccttgggttgactgacaagttcattttggggattcatctggccatttataaataaactcctttcttattccatattcctaactgcacctgccacgcagatgatcggctgcctggcactcacataaaaatttcaaattgctagcaatagctcaacatggtagttaaaggaaatcttctggttattttatgatataatcaagagaacccatttccccaccattgtagatatctcaggtccatgcacaaaacccaagtgaatttcattctttgccccctaaccacgtttaaataaatgacatccaagtacatagctgtaaaatgatcttttgacacttaagctttcgaaagtcccctgtcaaagctgtgtgactctgagtaagtcactgaatctctctgagcttgttttcttgtttgaaagatgaaaatgtattcatggcactgctgataaggtcgacaaggtaacagaagttagcatgtttaaagctccccagggtggaaagaagcttctaatattatctcattcagctccaagaagagaagtgaccttttccaggctggtaagtggcaggggggtggagcgggggtatatgaactcagcaccgcctgaggcagctgctcacagaaagaaaatgtatcattgatcttattggtgattttactcctatgcttggtctgaaattccatttggtctcagcggcctcaaggttagcataggaagaattaagctctctgttaggcttcacatcaacaaggcaattctagttcatctagaagtaattccagggcctccaggagtcatcaaagcaaaagttcttagagcccaaatgcctggtgctgatgtatctaatgtattcattgttcagtgtattttgctagcagtagccagatgtaccttgatatttgcattagtatacaatttctcttaaagactgtttatattttaaaaggttttgagtagtgctaactattaacttgggcaggaaaaattctctgctgaaagaaaatcgggcatatgtggtggagctttcaggctaaagcagaagatatttcgcttttgtttactcaacagatattttctgaatacctgcctgggtttgtgtttggtggtattctgtcactgttgctctttttcagctttcattagagtgaggaagatgaacactaattggatcatatgtttatcaagtgtttactatgtgtcaagcagtgagctaggcacttagcatatgctagttatcttagcccaactgtgtaaagcagcaactacgttacccccactttatagatgaggaaatgggggcctaaagaagcacatgggtgtgcacaaagtcccatcgctgggagtatagggtcagaatacagatgcaggcaggctctatgacaatgggctttgatgagtcagagtcacttgatgaacttaacatttggcctctagtccacgaagtgagttgatttctgctgagtgatgggcacttggtcatccattttactatctttccactttcttttatgtttgacatgttccatgataaaaattacatatatgtttttaaagtacagtctctggagctagactgcaaaataggaataacaataccatcatccttatgggattgttgtgaggatgaaatgaattgatacaaacaaagcatttagagctgattgcattggaaatattcaaggtatataagctattacctactataactgctaagatggaaaaccctgtagtgtttagcatatatagcaagtcccctgcatgaggtcctgaatatgacagactactgcacattttcctaaaattttaagttatctgatatgcctgaatacataaactttgcttagaaatataagtgaaccagtctcatatctaattatagtatttcatttactactttagtaatagtgatatctatataatatttaaaatcacttatttataataaataaatttagaaatactgttcttgctcactcttttgtttcagtaaaactactttattgcaattcttcacatataattcttgattcagtctaacgtctctttctcaagcagttgctatttaaaataaattagttgagaaagtaaccttcatgtgtgagaaagtcatgcccaaattgacagagtcttagcttaggaacggttttaaggtgtagatgccagtcttatataccagcatttacagtactgtggtttgagggctgatgaattgttgacctggctggtgagagtgggtggggtggctgggagctggttgctggaagctctgagaatgaagaggtgagagcaaaagagagaaggcagatgaagccaagctggtcccggtcagattgcactgacttttaatctattttttttttcattataaaagtaatacattgctgctggaaggcatttggacaacatcgaaaagtaaaaagaaaaacaaatccattaatcccactgcagagagggcactgtaatcgttattttgctgtctttgatccaagcatgaatgctctttctctagataacctcatggctcaaatgtcacctgctcagtgtcatgggatgactgcctaatatgaggactgtcatatttagcaaataaaaataaaggcacccaattaaatttggattttaaacagcaaatttcttttggtatacacacttcccaaatagtgcaattattaattgcctgcctgaaattcaaattcaactgggtactcaatattttatctggcaattctatcccatggccgatggcacttacaccccttctccattctccggtactcccaaactcccaacacctaaaataatttatcacacttattatttattttctgattcttcccattagaatgtaaattacacaagagcatgagtttttatctgttttactcattgaagtgttgccaaaatctactaaaggtgtatcacacacacacacacacacacacacacacacacactttagaatcttactatacatataccttcatattcttctttttccttaatcttactccaaggacatttcaggacacttttttgtttctttcaaacacattattttcatggctattttgaagttgcccaattaaatgatccaatcccctattagagaacatttggttgttggaagtttttctccattataattagtgccctgatgggaagctcagcaggactgcaggtgcctaagattctgcccactctaaagcaggagagatctaggagtaattctggctataccctcttactagctaggtgactttgcacaggtcactgactcttccagcctcagtcccccagttgtaaaccgagatgctagtagaacctggctctacttggtattgtttgaactcaatacgatgatgtgtcagggttcctggtaggtgcctgcatggagtgagcactcaccaagacatgcagttattattagtatcattccctacctcaacacctctccctccctctctcctctcttccctcctcaccttagtaattatttccctttatgcaacaggccaaatctatccatttccaagccaccatacttcctgcttcttaggtccataattgctttctctatcccaagcccactgccaggttaactcctgctgatttagggataccaagagagatcagcctttgaagcttttctgaacactcaacgtctgcccccaggcccacgcttggtcagaaccctgcttgagcatccacatttttcccattagcacactgactacctcgccacacaatggcctgggtgtttgcttttcacttcatttgagtgagcatctgcagaaaagcaatgactagccttccctacttccattctaggactgactgagagccttcttagtgtcctgccctgcacaagcacaggttagagggagaatccactaccaaaaaaatcccagacatttacttgccagttcctagatcaaaaacatgtgggcctcctttctgcccctgaacccagagtttagttgggcattattcttgttcttcaaaggaagtggtaggtagggacagggtggatggtaattgatatttcatggtgactgaaagacttgtaagtacctatttaaaaaaaagtcaatgactccattacaatttaaaagaaaaggagaaaaatagccaaatgacagttatcacataaagataggagccagtaccccactatgagtttgaccagcatgatttgtaattctgagaaaatcctgatgatagataaaatattaccattgttctaattttatttgtttatttagttattgagacagggtctcactctatcacccaggctggagtacagttgcataaacatggctcactgcaactttgacctcccaggctcaagcgatcctcctgcctcaacctcccaagttgctgggactacgggtgggtgccaccatgcctgggctggcctcctgggatcctgggctcaagtgattcttctgccttggcctcctaaagtgctatgattacagacgagagccaccgatgcccagcctattctcatgttgtaggtcagtaaagaagttcagagagggtaggttatttgcgcaatgtctcatttaatcaggggaggagatgggattagaattcaaggtcttcctgacacccaaacctctgcaaacagtatgaatttaaggctccacaatagatactatgatgtagaagcaactgattttccaaaaggttcttgggttatttatttattgcaaaggcattttacctccctgcacatttatgtaagtggtcccatgagttggtagaattctctgaaaaccaatacattctgaaagcaagcttaatacatttatttgtacagattgagcatccctaatccaataatctgaaatttgaaatgctccaaaattggaaactttttgagtgcgacatgacacctcaggtggaaaattccataccttttctttctgccggttcaatgtacacacactttatttaatgcacaggattgttaaaactattgtatacaattcccttcaggctatatgcataaggtgtatatgaaacatatgaatttcatgtttagacttgggtcccatctccaggatatttctttatgtctatgcaaatattccaaaatctgaaaaagtcagaaatctgaaacacttctctagtcccaagcatttcagataaggggatactcaacttgtacttagtaagcaccaggggtcaagtctttgctaggagaccaaagggatgctctgtatctattcataagagggtggaagtggaagcggtcatggttttggcacaggggcaaaggatgtgagttagaactggatcctggaaggctttctgaaaggagtttggtagtagtatcctatcaaggtcttagtaatctgggcatagtttctgcagaatcaaattctcctatattcaacaggacagcaaatgaagactgtattgattttctgcttagatcaataaataagataaattgaccagaagggctaaatactgatcagggtgaactgaacatcaacatttactaagagcagagggaggagaaacataaatatcagaaaaatggagatgccaatagagcactggggcagtggctcagtttccagttaaaatgtgtgtgtaaggattattattttagtcatgtctttacataaaaaaagggagtggaattaggttattacaataaaacttcatttagtcagactgtgagaagaccaattgatttttaaaaaacaataaatgccattgaatttaaatgcatggatatgatatggcaagacaaacaaataaacaaatagtcagaagacctgagtcattaagtgtccttgttaagtgcagaaaatcacatattattcataagtgtattctatttgccaagcacagaacctggaatatagatgaaatcttggattgagttctatgagagctgacccagagctaaggaatgtggtaatagtagttgatttgggaggtgattccaggaagcaagtgagggactgagaattgagccaaggaatggaggaaagcaaacaagggtgtatgtattagttcattttcatactactataaagaaatacctgaggctaggtaatttattttttaaatttttattttgatttttttatgagatggagtttccctcttgttgcccaggctggagtgcaatggcattatcttggcctactccgcctcccaggttcaagcaatcctcctgcctcagcctccagagtagctgggattacaggtgcctggctaattttatgtgtttttagtagagacagggtttcaccatgttggccaggatggtctcaaactcttgacctcaggtgatccgcctgcctcagcctcccaaagtgctgggattacaggcatgagctgccgtgcccctcctagactgggtaatttattaaaaaagaggtttaattgactcacagttccacatggctggggaggtcttgggaaacttacaatcatggcagaaggggaagcagggacgtctcacatggtggcaggtaagagaagagggcagggaaaactgccatttataagaccattagatctcatgagaactcactcatttaccatcatgagaacagcatggggacaccatcccagtgatccaatcaccttcctcccttgacacatgtggattacaattcgagatgagatttgcgtggggacacagagccaaaccatatcagtgtgttaatgagggggctaccaggtgggcaacaagaactcgatctcgttatggtctctctgagagactgggtaagatacaaccctgaatctttctgtgaaggggcaagaaatgtggcatatttttctaccaacctcctgttcatcttttgctgtggattgtgcctaaggccatcatcactgcccacctgctcccaaaaaaataacctcaggcagacagatttaggtgcagcgcactgaaggtgcaggtgacagctgtcaaggaccaaatgtagatgggaaggacacatggcaagtggtaataccaggcgaaggactgcaagatcaagctctgtgctctgtgacgattgtcaagtcaatctcctctctgggcaatcagggtctaactctaaaaagcgaggcttgaatcttcacattccctcccagactgagtgccagtaattctgaaaaccagatggtcaaactcacaatcaaggattacaggccatttaggaaactgcttctcacacagataaaaatgatacatgatgagcattccacttgttagcgtttaactgtgagcttttcaagtgcttgaacatacacacaaagatgtacatgcactaagtgatcactgaggcattgtttgtagtagcaaaaaactgaaaacaacctaaatactcttcagttaggacatcgctgaataaaactggcatattcatatgccggaatgttctcctgcacttaaaaggaacgaactgaatctatatgtgtcaccatgaacagagttcaaaaaatattgctgagagtaaaaaaaaaaatcaagatgcagaatgttatatatagtctgacaccatttaaaaaaaacaagcacacattacagcattcctatgggtaggttacatatctggaaaagtatttttaaaggactgaagtgacaacacaaactcatttaaagttattttggaaataacttttccaaaaatcacatttatatgagtggctacttttgggcagggagagctgggacaaagactagattagcaatgacaaatgtggatggggtagtcagagtgattttagttatagtgatattgttctaatttatgaaagcagaattgattcatgcatttttaagtgaacttaaaaaaagagagaaatgtctagtacgtagcctagtatcacaggagactacacgataatgtggaaggagtttgaagctggatgcattggctcgtgtctgtaatcccagcactttgggaggccaaggtggaaggatcgcttgagtgcagaagtttgagaccaccctgggcaacatagtgagaccctatctctacaaaaaatagaaaaaatagcgccaagcatggtggtgtatgcttgtggtctcagctactcgggtggctaagatgggaggatcactttagccttggaggtcaacagctgcagtgagctatgatcacaccactgcactccagcctgggtgacagaacaagaccctgtctcaaaaaaaaaaaaaagagtttggaaaatagagtcagaaagacctggtgaacctacttcgcaaataacttctctgctaagagccttcacttcttcagttccaagattgacaaaacagaccaacttcatgaagccgagtgaccacagggcaacctgtagtgtcttctgtctggatcataaatttgcattcatctcctgtttattccctgctctcttatctgtgttttttcatattttaaaaaagtgttaaaaattattccttttatgttttttatttttttgagacagggtctcgctatgttgtacaggttggagtgcagtggcacgttcacatctcactgcagcgttgatctccctggctcaagcaatcctcccatttaagccacccaagtagtgagactaaaggcatgtgccaccacacttgcctaatttttttaaatatattttgtagagatgggtctcactatatcgccctagctggtctcaaactcttgggctcaagtgatcctctttcttgccttgacctcctaaaatgctgggatttcaggcatgagctaccatatgcagtgttatttctttattgagttgaaagttgaggttcctgcctaacccccatggaatcaggtatttgattaaatagactcagtattaacaaggttttgatgttttcttaattcctatagtgccagttgatattggaactgagcaaccattcagctacacatgaatataccattttacctggctttgtgggtatcagtgattatcaatgaggaggcattccacaatgacaacactagggggtcttatcaaagtcaaagggacataccatacacctgagttagaactgctggagttaaatccaatcaggagaagctgttagggcagactggccttttccataatggtgtccaaaggtgttcaggcctcttgcttttacatgggctgtttcctcacctggaactctgttctctctcccaacattcccatgcccacatcctattttcctttaggttattttctccatgttgccttcatgaataaatttcctccccacaaaataataatgatcatgaaccatcctttgcaaaattataacagtgagaaaaacccaacataggagaaatatgacagtggaagatatctgacataaccaactccatcttgcttctaacctccaagctatccttgtttattcctggtggaggctatggtaacctcaggaggaattcagtttacagtttaactttgaaacaaagataataacagctccttcctgaaacaaaacccatccttgcttggagaccacactgcctttgtaaaacaaacaaattagccacaggattaaaagttatggctcaggagtcatgcagccagagatcacaggattcctaacctccccaactgctcctgcatataacactactgttgtaaaacctaagattggtatttgaggtattttttcacatcctgcattccgatatccaagcagacccgtaaaagtggctcatctggtattgtggcccccacctaggaactgactcagcacaagaagacaagatttaactccctattcatttcatccccaacccaacaaatctgcattccccattccctaggcccctgctcgtcaaactatctttaaaaaaccttagcctccaaattttcagtgaggctgatttgagtaataaactcctctcctatcacttaactgaatctgcatttattaaactatttctctattgcaatgctgctgtttcagtaaattgactctgtctgtgcagagggcaagaaaaacctgttgggcaatgacaatcatgatgatgatagttaccatttgtagacaccatgctggatcctcatctaatcctcatagcaaccctgacaactaagcctccatattcccattttatgaaagaagacatcaagattcagagagtgtggaaggacatgacagagaagggtttgtcatttttttcaggggtgatgctttttgatcttctcccccctcaccacatttatggctgcctggagtctatggtttctgtgatatgtaatttgtagagagagaaatcattttgaggattttttcttattgagagctatattcctaggcttaaccctcagaaatgaaaagtttaaaagttaaagtacaagtcagagagaaaaaatagagccctctgaaatgatctaaagtaagaagtcagaccgattcttcaaggcagcacacacagaatggaggcaaggcaggaagcctaccattggttccagctcatcctgcaggaaggatgaagaggaactaagccatcacctcacctgcttcctccctcccttctccatctccctctttcctgcccccctctttcttctccctccaccttcgtttggttctcaggctccacaggaaataagtgggaggggacagcacatttactttgtaaagcaataaggagactgcttctctacgggctttattttatttttgccataagcttctcccggcttgccagcgggtaaaacgttttaccatatccaagaatttctttctttctttttttaaactggacttcctaaaaatgaagaaagaaatgtgaaaaatttgttcaaagttaaacatagaatgagtggctgtggttgcaattttacctaaattccgactccaaatcctatttccggctactgattgtgtgtgtgtgtgtgtgtgtgcgcgtgtgcaagtgtgtgaaagctgcattattcatatggccatttttactttaactcaccttatatgcccatatgcccaggcaataacgcattgcatatatgacagtggtcctttaaaattattttggaaggctgggtgcagtggcttacacccataaggaggctgaggtgggaggatcctttgagcccaggagtttgagaccagcctgggtaacatagtaaaaccttattgctacagaaaaaaaataatttataattagccagacatagtggcatatggctgtagtcccaggtactcaggcagctgaggtagagggttgcctgagtttaagaggttgaggcagcagtgagctgagatcataatggagctgaaaaattcctgttgcttaatgacattgcgacagtctgcataacattgtaacaatgcattaatcacctgtttgtggtcatgctggtataaacaaacttactgaactgccagttatataagagtatagcacatacaattaatgtgcagtatataatagttgataataataatacatgactatgttactggtttatgtatttattatagtatactattgattgttattttagagtatattcctacttatatcttttaaaagttaactgttataggccaggcacggtggctcacgcctgtaatcccagcactttgggaggccaagatcacccgaggtcaggagttccaggccagcctggccaacatggtgaaaccctgtctctattgaaaatacaaaaattagccaggcatggtggtatgtgcctataatcccagctactcaggaggctgaggcagaattacttgaacccgggaggcagaggttgcagtgagccaagatcatgccactgcactcaagcctgggcagcagagtgagactcttgtttcaaataaataaataaataaataaacaaacataatataaaatgaaataaaataaaataaaagttaactgttataaagcctcaggcatgtccttcaggaggtatttcagaagaaggcactgttaccataggagatgacagctccatatgtgttactgccccagaagactttccagtgggaaaagatatggaggtggaagacagtgatattaatgatcctgaccctgtggaaacctaggctaatacgtgcatttgtgccttagtttttaacaagaaaagtttaaaaaataaaaatagaaaaaaggtttatagaataaacatataaagaaagaaaatatttttgtacagctgtacaatgtgtttgtgtttcaagatgtgttacataaaagtgtaaagtttgaaaaatgaaaattttataaagtaaaaaatataccatattttggtgtacattttctatgcttagatacacaaataccattgtgttacaattgcctacagtattcagtacagcaatttgctgtataggtttatagcccaggaggctgtgtcacataactaggtgtgcactaggctatactatctgggtttgtgtagtataatctaggatgttgtcacaatgacagaatcgcctaatggtacatttctcagaagatatccctgttgttaatcgatgcatgactgtatatccttttggttctgctttttctagagaaccctgattaatataagtctatcctcaacaaagctgccagaggattccttttgaaacttagggtagatactgttccttatctgtttaaagccttccactggcttccaggagtaaatgtttttttacttctttactttacaactttttacttctttaaaagtaaaagttaaggctattcccatgtctttgaagagcccagtaggatctgaccatccattaccactttgaccacatctcccattacttcccccaactctgtctcttgaaacaccagggattttctgcctcagggcctttgcacttgctgttgttctctttggaatgatattttccagacatccatatgctgcattcctcctcctcttcacttcctcctcctcctttttatttgcccaaatactgtattcttgggagagcttccctgattcttctacttaaaattgtggctctcaccccaccatcatcactcttaagcccctgctgtaattttaccctgctgtacttttatggcacttattacctcgaatctactgtataatttacctgtttatcatgctattttttgtcttctccccctagaatgtaaaatcgttgttggcagagatctttgttttatatactgatgtttacttagcattagtatctagtacatagtggatatttgcgaccaattggattttccaaagctggccacaacagtatctcccatctcacacgtacctcttgcaatgtgaccttgagtgttagggtctcttaagaaatggaaatgacccaggactttctgctgtagaaaacagacatagataccactcaacaggtgaattaataataactgacacttctatagcaaaacttggacatatcctggcctgggtgctgaacccacctcctcctcttctggatatgagacatactctctctctgggccttaggttccttgttgagatggactaaatgagatgatatagggaaagagctcagcccagggtgtggcatgtgagagtcatgaggctgtattaatagtttgacatttgtttttttccatgcagaggcctgaggcccaaaggaaagaggtccaaaaaggcctgtttacctctacatcaggctgatgccctggggatgtgcttcacaggggactggcatagcagatgggcaagaaggggccagctctcacttgccttctagtctctgccaggaacacacccctccctcagcttttgggctttccaatgcctgatcaatgttcatgtctcagatcattagttgcatttgaaagcctcccctagtctcccagggttgagagtttctgctgtgcgccacagggtccccatccttctaccatccttgccagaatcatgtcagaatgtgagtgttgtatgtccctctcattcaactgcacatgggtgaggacaggagtagagactcccttgcttctggtacagctctaaggcctaccacagggcctggcatacatacggtagaaattgagcagctctgggaagtgtgtctctccaggacacaggagcatcaggggttaaggctgcagaaggctcctatgtcctcgtggcagacagtctcaaagggctgcctgatggggtaggacacagacagtctgaggaataaccatgaggtggcaggtgggaccgcagaatgacactcacagtctggtcaggctgttcatatttaagaggctgtactgtgttgtggttcaagtcctgtcctgggagccagactgcctgctctccaatcccagctatgttgcttactacctatgggacctcagacaatttacttcagccctgtgggcttcagtttcttcatctgtaaaagaggaataatgaggttacccatcttagaaggttggaatcacaaagatcaaatgagttcattaatacatgtaaaccactaagaatggcacttggcatagttggagtgctatagaagtgtcagttattattaatccacctgttgaatggtatctatgtctgttttctgcagcagaaagacctaggccatttccatttcttaagaaattcacgacaaacaggattacaaaaataaactcaagattaaggctgcgtgatgaacatctctcaatctttctggagtgtacagtggctgtgcactctagaaattcatttggtggtaacgttacagctctatgtttgcagccatttgtgactatgaggcccaggccaaatgcccttccaccctccgcacccccaactctcctccaagtcctccaaaggcccctctgtggtcctattttttggcagagaatgaggagcaggcctggccttctgaaaccctctccactcccagccttgggagcctcttgtctccccctccttccttagagtcttggctatttgaggaaactgaaaagactgcccagggagctaatcttgggcttcacttctggaggggccgcgggtgggtggggaggcagattttcctgtacagaagagcgtgtgctccttttgaaatgtcctagcggaaataaatgtacaacctattgtatgctgccaggagccaccagcaggagttggtgtgatacaaaagcggcatttgtaatggcacaaaacacttagcactttaccaagacatgcacaggatataaaaggagacgaagggcctgacgaatccgccaagaaagcagcgtgtcctgaatgcaggagagccaaccactacaccccaacacacagtctttatcctcttaaccatgctaccctttcgttagtatagaagggagtatttggacacaggcaggaaagaccaggtcggtctccttcatgtgccttacactcagtcacttgcctttgtcttcctaagcagatgggcccgcccctcacattcacagtgcccagggcaagagaacaaattgcctagtacaataagactaaataatggaaagctatatattaaagtaacaagacactaaatgtgttttatgctcttacaatgacaaatataccttcataacaacctggaaggtgaggctcaaatttagatttactgaatttccttggaagagtgggtggcttaagggtagacctccaatattcacggtgctcagggcacccagatacacagggaagcacagcagtaagtgatccctgttttttttttttttgggggggggtgcggggggtgtgccgtttaagagcctaggagtcagacatcctcattcagagatgtggaaaatgctttctctgtctctctaaagctttgtttccccattttcccctttgcacttgtgcccttcacagccttggagaagcagcaggttcctgttctccactgaccctccagaccttagatttctgccaaagccagaggagagacctcctgtgcctcacgctcagtgcttggggctcgagatgaccagggaaggttgcaaggaccctgcccccaaagaattcacaggctcttgggaagacaagaagcccaaattcacctgagctactaaataacataagtgataaggatcaaaaagagtggatggtgtgcaagatagtcacacttgaggaccaaatcctgggaaagtggcccagaaaggaaccagaggaacctttttgttcaatgttagggaaaaacaaaaggcagaacctttcaaaggaaacatgactttatgtggaatctggacataggaaactgaagaaagcaaagctgtgcttttcgggagaagcaggatgggagtggggaactgagattccagcccccccagacacttttgtctttcccccttccatggacagaagacccttctctcattccactcttcccaacgcccatggaatgccaggtgtctgggcagccctatgttaaatactgttggtctagtctaatcttttaaagtaaaagaagaatggttttcttatgtgcccctcaccacctatagactgtcagcttctaggagacagcttctggaccttgtttttgttttttggtttgtttgtttttgtacctcagagtctggtatttggtgactactcagggagtgtgagttgagatgggttgaaggggaaatgtcagcccagaatcagaatatggagggaaagacttgaggtaattcaaccagcaaaataccgcaattacttttgtgccaacctaataccttgaagttagagttttatattattatcaataaatatcatgaaatctatagccccttaaaatgtctctattaatatttttctagctcatttccctgtgtagtatttgtccattaattatcttacagtaacaattgctaacctttattgagcaactataatgtaatctttactacgagcattgcattcattttctcatctgactctcagaacaaccccttcagctaggactatgattccctttatgtagatgatacactaggattcaaagggcttaagagaattgtacgagatcactcagctacaaagtgtgaaacgtggagtaggacccacagtgtgtgtttactgattgtttaagaagagtaggttgtagagtcagtaatgtgggggacccgttcccttttccctggcctgcagcagcagagctgggtagtgaatttctctcactgcagcttagaagcctgtgtctcaggctttcctcagaagccaagacacctcagttttcagtactggccctgaggcacatcagagagtatgagacaacccctcagggaagtgtccgaggcaggctccaagaagtgacagcttgctcaaatcccagatccaggaaaagcttctgacctctgtttcggagtgtgctgcacctttgtctggaaaggcagacctgccttcatgggctctcccattggtgttaagcaaggctaaatgggggctatatttcactctagaagtggctgcatttcaggagcagagtgtgattaagaaagatggatggcgggtaatatccgttaccaacacctgtaccgtgctcagggatctatttggcagaaaggggctatgtaagagcaagatcattaccatttgagctagaaaacaaaatgtggtggaggtggtgaaggatgggcggaaatgggagggaatggaggatgacagaaggcgggaggtaaggtgctgcaggaaaatcctatgctgcaggacgtgggtccgaagcctcctgggcctcaaattccccctagtaagatgctgacagccttagaggttctgtcttgctcattactgaaggctgtaggaggcatcgtttggaggcaaccacacccaacagtaagactaggtcagctctcaagaatagccagaactgagttattagctaaatgcggatagcctcacccctcacattttgagaggcaggatctctggctctggaatctcaaacctgaagcataaaggcttgcagggtgaggcgtgtgggcgaaaagaaatgacacagtctatagatctggatgggttgtggtccaaattcttccacatatcttctaggttaacaaatttgagtcaacattttcagaaagggagagaaagataaaaggagcttggataagactaaaatagactttagggtttatcagataagggcaggtttcagttctgccacttgtttgctctgtaagcccaaatgagttgtagtttttctctaagtcagccttttcctcatctgtaaaatggggaaaaaagacccacctcacagagttactatgagtattaaatggagtaatgatttataaattcttagtacagaacctgccagacaattgactcaataaatggaggctatcatttccaacctcttcctcaccataaaaacatgatggtcaccaccaccatcattagcctggatcaagaaagctttctgtttttattctggttgtttcctttcttgaaagtctctcgcagagccaaaggagaaccttgttctgtgtggctccagaaggaagacaaaatcaactggcatcaaactacagagagaggtggggaaagagcagggtgagaattagcccacatttgacacttccttttcattgttcagagcagccactattttctgtttgagaagctgtgtatgcagagatgcatatcatgtgcctataccatgtgtggcattataatgtatgcgtgtataatatgtacattatagattatgacatacacatgcatgaagtagattcaggagacctgggtgaagtgatggggctacttgtacatctgggtgaagtgcatttcctgatgaggaaatgggaaaggcaaaggccctgaagcaaaactaagcatggagtgctagaaggacaacaaacaggcgagggactggagtgggatggtggtaggaactggtaaaagtaggcaggggtcagatcagaaagaacttcataggcagtggggaggacactggattcattctaaatgtgctaaaaaagccatggcagggaggcatttgggcaggaggtgaaatgatctgatttttattttaagttgataattccagatattgtgcagaggtggagaatggattgtgttagagatgggtcagaggcgtgtgttagagatgggttagagatgggccagtcaagaggtcaccatcttccaaggtcagtgatgatgatggcttggactaggagaatgaatgagtgtgttgagacatacttgaaaaattgctgcattttcaagttggagctgacaggatatgctgatggtttgactatgggtgtgagagacagaactagtcaaggataactccaagtgttttggcctgagtaataggatgcatgttggttcaatttccagtgtagggaaaactgtgggagaaacaggttgagggaataatgagttccgtgtcagacatggtacgtttgagatgtccattagctgtccaaatggaggcatttacgatgagattgggactggagctattggcatttagaacttcagcattgaatgaaatcacctggggagtgagaggtctcaggattgcaccttggtgccctctaacacatagaggtcagaaagaagggaggatatagcagggagagtgagctgcctgtgaggtaggcagaaaaccagtaaagagtgttgtcttcgaagccaaattaaaaacaaacaaacaaaaagatttctaacaggaaggagtgaccagctattttatatgagagaaagcattcagcaaatggaaactgagaattggtcattggatttggccagatggaggtcattgggaacatcaacgacgagattttataatattcctgggagacaggggaaggatgagagccctggtggaaggggaatcaaggcagaaagaaggcaaggaattgaagatggtgcaaacaggtaagtctctggaccaaaataggcatgacccagttgaggggagaaattgcaggagcaaagcccaccatggtgaaaggaatgtctagggcctgaatacaagtacagtccaaattttttggggcctgagctaatgcaatttgaagtcctctttaagaaaaaagaatacaaagttatacattcaaaaattaggcatagaattgaatatttatttagtacaagaagagaaatcatgacaaatcgacagcactttaaagatgcgtgtatctttcttctgaaacctctttaagctaggatttcttaacctctgcaacactggcatttcgggtcggataatcctttgtaggggactgtcccacgcgtgataggatttagcagcacccctgtcatctacccactaggtgccagtagcacctcccaaatcatgacaaccaaaaatgtttccagacatcgcccaccactaccttaaaaaccattgctttaggttatttacttgacacgcttacatacaaacgttcctgattacaacccccatctttaacattctgcaatcctcagtaaccttcagcactggctggggccggaagtggaggatcctgaagctgaggcttctggtaaatccacctttgcctgagttgagggactggactcaaacagacacaggaagagtgcccatcataaaagaaaaaaaaaccagaaaagaagggtttggatgccagtagttaatagacttgattcttctcattacttatattttctcagtgcaataaaaagcaaggatatctgttaagagggtgacagtgggaggctgttggagttttgcatggagagaagggatgaaatagtcattctgcaaagtaagagtgagcggactgggattcttacgaatcctgctagaagtagggtagagcgagaccagtctgagcagctcaaagacggcttgagcactttataaagcagcatctgccttatcaccagaggtacctgccttataacaggtattcaagtagcaatggaaagtcagaccaaatgatcctactagtccttcttcttcttttgtgattctgtgatttttatagcaaagcaacctgatggcctccagtatatcagacaaaattattccatagcatcttcattcgcaagcgagtaagatccatcccacgaaataatgatcctgatggctaagagtgcatgcccaggataagagctttccatgctttatcttatttaatcatactcacagcatgggaagaaagtttaagaaagatcaagacgcttatccattgacacacagctggtaaaaattatattacccagattgaggaacattctacaaaatgcctgaccagttttacttaaaactctcaaggtcatgacaaacaaatgaagactgaaaaactgtctctggccagaaaaaaactaagaagacataataagtaaaagtaattatagtatcttggattggactctggaacagaaagaggatattagtggaaaaactggtgaaattcaaataaggtctggaatttaattaattgtacagcaccaatgctggtttcttagtttttacaactgtatcatggtaaagtaagttgttaacattaaaagaaaataggtggtttatgcgcggtggctcacgcttgtaatcccagcactttgggaggccgaggcaggcggatcacgaggtcaggagatcgagaacatcctggctaacacggtgaaaccccgtcctactaaaaatacaaaaaagttagccaggcgtggtggcaggcgcctgttgtctgggaggctgaggcaggagaatgacgtgaacccagtggggagcttgcagtgagccaagattgcgccactgcactccagcctgggcagcagagggaaactccacctcaaacaaacaaacaaacaaacaaacaaaacctctgtgtattattatctctgtaatttttctataaatctaaaattagttaaaaaaaacttgcctagaaacaacaacaatgacaagtgtgtgactaactccctggcattctaactccaggaagctttgcttctctgtgatgggtcagggcactggaatctgcaggttattctcctctattcaatgtgactgtgtctaaggtctctgctttctgcttttacacctacatgtgtcctccagctgcaaggcagcctggcacagtggagagagattgctttgaatccatgcaaacattggctgaaccttagttcccctattacttaactgtgagtgtggagaaaccactttctgtctcaaacttttggcttcttgcaactgtaccatgcaacccataatatctctttcctaggcttagagtcagattccaactggcaagtgagaaaagcaaagcagttggcacccagtaggtgctcagaaaacacaaggtccgccttcttcattctcagtgctaagaaagtgggagctcacccagcctctctctttctgacaagaacttctcatgtttaatttataggctggtttaggtagttgaattttaaataattcatagccttgctgttaatatttgtagttgttgaattcctttaataaaacatttagggatttcttccccctgaagtgtatttcatccggagaatgatttgttttctgaaatctgggactcggctgccctttcgttattttcttttctgcatctaatcctgtttattgctgtggcagaggtaagagatgcaagcttgggttttgctttgcatgggtatgcaggcagggatgtcaattcatctgtggctggggctcgtgaggtgggttcactctaagtgggggtaccatggcggttaagaacatcaacttcatactgtattaggtttgaactcaggcctgcacttccttcttccttgctgtgagatctcatccaggtaattattattattattttgagatggagtctcactctgtcgcccaggctggagtgcagtggtgtgatctcggctcggctcacggcaacctctgcctcctgggtttaagtgattctcctgcctcagcctcccaggtagctgggactcctggcatgtgccacgacacatggctaatttttgcatctttagtagaaacagagtttcgccatattgggcaggctggttttgaactcctgacctcaagtgatccacccacttcagcctcccaaactgctggaactacaggcatgagcaaccacacctggccttatccaggtaacttaacatttctgagcctttggtttctcatatgcaaaataagaatgagaacacactccttttactttccctgacatacctctggatttcaaaattctgcttatatccatggaggctgctttttctaatctctctcagcctcaacccccacttagtgcatttgatgtggcaaatagactcccttattaattctgttttctcatcaccttggcttgagccatttccacaagaactccaggctctttcctgattcccatgaaaccccgctggctttgtcatttcttagtacccctgggtttgagggaaggggaaggatgatttgggcatgctgcagccttttctaaaaggaggctccagctccctcttgaagatgcagaaggatctgaaatgcaaggcaagcttcacaggtgccaactgtattgttcaaagaatatactcccttttatagcacttatatttcattctctactgccagaatggagacacatgctgggtttctgcattcgtaattggggaagaacagatgggagagacgcagttggaagtaatactgtcattaaagtaatctatactgctcctaactctcaggcatgtgtgagaaggtgagtggagccacatggaccaagttcctttctgttcagtcctcatggaaattatggggtggcacatgactttggaagaatcagaaaattcacattcacttatggtattcctctgtgagtatgtttctagctccagagcctcaaagacaagaaaaggaacagattgatgatagtttccttaggtaaggagtggagtaggcattctagatagagagaacagcatatgcagaggtgtggagcctggaaataggaaatgttttaagtaatagtaagtagagaagctgagctggtcttgttagggaagcagcagaggatatggctagaagaactcgtgctatggggacgaggttcttgaataccaggaaagaagctgaaggagagttgctgtggcatggcagagcaaaggctgcaatcaggttcagtgcaggctgttactgactagctatgtgaacatgagaaagacacttctcttttctgggccccagtgcttcatctgcaaaatgggaatagaataaatggtctaaatagaacttcagtggcttgaaggacaacagctctgaacttcaggagaatgcatctaattcctgagtcttttggtcatgtaagtcaattctaagctgagcatatcccagtccttgttgactgagtaataataataataacagcatttgtaaaataatagagtgaccctttgctgaggtcctactctgtgccagacactgtaaagtgttttattattattattattattattatttatatatatttttttttacaatctcaatctcagtcttcatgaggtggtcctgagaagcccactgtacagatcttcacatctgaggctcagatagggaagaggataggaatttatgccacccaaccctgggtggcaggaccaagaattatgccagatgtcactggcagctgccacagcagtaatggcacctcctaaggcagagcactctggagaggtttaatgttcgctggctaatttaatccctcccactgcacctcaaagtggatcctgggatccccattttgtagatgagctaactaaggctctgtgagaagcaatcaccagctcaaagtcataaaaccagtaaaggctgaagctgagctctggcctcaggtctgcctggtattcaacctccagatgctgccttaggatacttcagccttcaaattcacacaggaggagcccaggattagtgggcagctccacagccccttctcccaaaatgtgagatgttctttgcaaacttttcttagggatgcctcattttgacagaacacactgccctctcttgccctggggagcagtccccattaagatatgtcaatgccattgaatacaaagcaaatatctgggctgatatcttaacatgtctgtagcagtgactctagactccctaaaagaccaaaaagttctcatggccatggtcatggacaaacttcttgggaagaggcttttgcagactagcacatcagcacaaggtctcaaagttgacttttcactgtttactcctgaggaggtgtggacataataagaactatgtatttggcctctgcctcaagttcctgacatagagctcccaaaacccttgtaatgtcctgactggtaagagcatattttgttttaatgaggtgattcttggtgggatcctggatagcttcaggatgggagctggtcaccagaaagggcaagccatgattagaaacttggaactttcagcctcaactccccattatctgggaagagaagaggagctggagagttaatcacgtcaatcttggctacatgatgaagcctccataaaaatccttaagctgcagggcctgaagagtatctgagttggtggatgcatccatgtgcctggagggtggtgcaccccaattgcatggggacagaagctcctgcacttgggatttttctggacctcacgctatgtacttcttcatctgtctgttcatctgcatcctttagaataaaccagtaaaaatcaaagtaaatatttccctgagttttgtgacctgttctgacaaattattgaacctggatggggagtgaggtggaaagtggcttgcagtggggttatgggtacccctgaatttgtagccaagtcagagggaactgtgaggatacttgtgtcaggtgtctgaagtgagggcagtcttctgggactaagatttcaaacccacatggagtttttgtcagaactgaattaaattgcaggacacttagctggtgtccagagagttagaaaactggttggtgtggggaaaacaatccctacatttggtgttggaagtgtggtgagtcaagatgcaggttttcctctagaatgtagccttatttccacatgttggggtttcatgttgttgtctgtccctgaccatgaatggcccaccatcagtgaaaagtgttgagccgtcaaagcaagatcacatctcctcagacacccaaagtcttgtggtaggaaggctgggagagagagtgaaaattcacagagtagcaactttgtccaaattagctcagaaatgtctcatcacagccatgaaagatggttactatatgattgtttccatcttacaggtgaggaaaataagctcagaaaggtgtaaacagcttgcccaagatcagtgttaagtgatagaggcaaaattttaaattcaagtctttggccgtctgacaccaacacctggaccctttggcctacattccatttcctcctatagtagaaagatgtgggccaggtgtggtggctcatgcctgtaatcccaccactttgggaggccaaggtgggcagattgcttgagctcaggagtttgagaccagcaacaaagtgagacccgtctctacaaaaattactaaaattaactaggtgtggtggtgtgtgcctgtggccccagctacttgggaggctgagattgcttgagcctgggaggcagaggtcgcagtgagccaagattgtgccactgaactccagcctgggtgacagggtgagacccagtctcaaaaaaacaaaaacaaaaacaaaaacaaaaccaatatgaatgtagttggtcttccctttctcacttctatccccatctttcccattgatccaagattctataagagtttaagaaatgttattgttccagccattggggctggaaaaaccctctatggagattttttttttctcccctcattattttgcttaagtgacagggaagtcttgtggactcctgtggattgcaaagaccccattcatattcatcacattcttactgcacacagtctgtgcatgttgttccttctgccccaagagctttttctcacctcctttccctttactcctgctcatcctgtagatgttagatcaactgtgactttctcaaaaaagctgtccaaccctctccataggtcccttgatcccagtgaactctcataacattgcactactttcctccctggcacatagctcagtttgcaagtattaataattggtgagtttttgagttaatgtcagccccaccccccaactagaccataagctctaagagggcagggtccatgtctacttggatcatgattgagccccccgttccatgcacagggcttagattactatagatgacccatcaatgtttactgagtgaataaacaaatgcgttaaagcataggacgtaaaaacttttgggtctggagacaatagaatttctgaacttgtgtcttaaagaggaatagctttttcctcataacttgttagaaatgcagaatcccaggcctcatcccaaaccctctacataagaatctgcaacttgccatgttctggtccccagaggattcctatgtacattaatgacttataaatactgcagaggagaaaaagttggaatggaaaggtgaagtagcctgtgttaattaattgatcatgtaattggttaattataaaagtttgtaaaattattctgagcaccttctatggatctggtactgtgttaggccctgggactctggcatgaacatgggagatatggtactagcctcaagatagtgcctgatatggtttggctgtgtcaccacctaaatctgaacttgaattgtatctcctagaattcctatgtgttgtgggagggacccagggggagataattgaatcatgggggctggtctttcccatgctattctcatgatagtgaataagtctcacgagatctgatgggtttatcaggggtttccgcttttgcttcttcctcattttctcttgccgccaccatgtaagaagagcctttcacctcccatcatgattctgatgcctccccagccatgtggaactgtaagtccaattaaacctctttttcttcccagccttgtgtatgtctttatcagtagcatatatatggactgatacagtaccccatacctgtgtggatgggcaaagcacccagagctagcagagtagagggagaggctgctcattgagcaggaaacagggagggctttctgcaggtgactagcagtggagggcacagggggcagcctcatagacaatgaaatttcctgtcctgtgtcacagtcttgaggctgggggatggagtcagcaggttgttgtaataatccagactagaaatgtaaacaggtcaccattctttctctcccagctcttccctgaattctcatgccattctgaaaaacctgcctaaaaccctttatgaatcagataagggccagattccataggcttctttcaaacttttttttcatattttttcatttacattctgcctctaaatgtcaatcttctaccttcttttctctctctgtgtttccctcctttccactgtttgccttgctagtgtccctctggcatctccattacacggactattatgcagctatcagaaatgatgtttacaaagactgtgtaataaacatggaacatgcttaggtttaataggaagctggtgcagagttgtatagacatatgattacagtcttataaacataagtctatatagttaacaaaattttaaaaagcaaactccagagtgagtcaaacaatatttatatgtgcctggggtttaaaaatatatatatttgagatgtttattttctatctttttatgactagggatttctttttacataataaataaaaaccacaaatttaaaattgttgctatttattcactgtatcattttgggcttttttttttaaacttccctgagcctcagttttctcatctctaaaagggagctgacagttgggcttcccacagaggatgttttgcgattgtactcaccaagtgtgctatggcacagagcctggcatgagagtaaaacctaaccccatagcagtaattatcatgtgaggatcagttcccagcttacctgattggtatagattgaatcaaaaacaagaagtttgatgtggtagggatggaggtggagggcaaggagttatccatttggaagtcctgattttgtggctatgtttgcccctaattgttgtgcgaccttggcaattcttcccatctctgggcttttgtctctccaaatgtagaagagaaatggaacctcaaagatcaacataatttcctcttacatgtctaaaagataatacctcaatttccttgggaacacactgtgaacgttttaacaatcctaaatattctactggacaaatactgcagcctctttctaatgtcccttaactccctgagtttcatggacctatgaatttttcatccttgcttcttaaaaacaacaaggtccctcctcctctgatgaccacagaacaattcttggttgtgtcaattgtttacaaaaacatcatttttttttttttttttttttttagctgagagcagtagctcacacctgtaatcagccctttaggaggctgaggcaggtggattgcttgatcccaggagtttgagactagcctgggctacatggcaaaaccccatctccactaaaaatacaaaaattagccaagcttgatggtggtctatagtcccatcctctttggaggctgcagtgggaggattgcttgagcccaggaggtgaaggctgcagtgagctgagatcacaccactgcactccagcctgggtgacagagcgagaatctgtctcaaaaaaaaaaaaaaaagtaattttttaatattaggaattagagtgtggtggtcatcagttcatggctgacagaaacagcacttcctgctctttgcaatttagttcttataatggacaagtcttgtttcaaatgctgcctccttggtattctgtgtacaatggaaatgggggttggattagatgctctctaaagatggtctgagctctaaaagttttcttcctggacagcagcagtttccctggataaaggacctttttcctgagcatgtggctctgtctcagaagcagcccctctccctggttccccagtagagcttccaggctcagatgagtagggccagctggctttgctctacatagaggccctaaataattttagtggcttaaaagcagaagaatggttctccagctcctgtaagaggcagaattaacagagaataacttaaagggaacagcatgaaagaggccaatggaaagatagaaataaaatgaagaatgggggcaaccaactttcagggtctctcaaaaaaaatcctgggtcaggatcccacctgtctactgcaagctcccttcttcctgctcacagtgccttcttgccttaatagtacaaagaaaaatgctttaccatgatttaggtactatgctaagctcttgaccatacatgcatcatttaaccctcagttacaatgttggctccatgagggcagggggattttgtctgatttgtttacagttgcatcccattttctagaacaataccaggaccccggtatgtgttcactgagtatttggtgaaatgatgaatgatgacttgctgaggtcactacgattactaactccattttacagatgaatacactgaagctcctagaggttaagttacctgctcaagacaacgtagctagtaggagcaaagccaggattcaagtctagctgatcttaaagcctgctttattttagactatgtcctcacaggaaatatccatctgttttagtctattctcacactgttacaatgaaatacctgagactgagtaatgtataaagaaaagaggttgaactagctcaccgttctacaggctttataggaagtatggccacatctgcttctggggaggcctcagggagtttctactcatggtggaagcaaagtgggagcatacatctgacatggtaggagcaggaccatgagagagatgggggaggtaccacacacttttagacaacaagatctcacaagaattcactatcatgatgacagtatcaagggggatgctcttaaaccatgagaaacagccaccatgatccaatcaccttccaccagacctgcatgagcctgttctcacactgctataaagaactacctggctgggcgtggtggctcacgcctgtaattccagcactttgggaggctgaggcgggcggatcacatggtcaggagattgagacaatactgactaacacggtgaaactctgtctgtactaaaaatacaaaaaattagccaggtgtggtggaggtcgcctgtagtcccagctgctccggaggctgaggcaggagaatggtgtgaacctgggaagcggagcttgcagtgagccgagattggaccactgtactccagcctgggcgaccgagcgagactccgtctaaaaaaaaaaaaaaaaaaaagaactacccaagactgggtaatttataaacaaaggaggtttaattgacttacagttctgcatggctggagaggcctcaggaaacttacaatcgtgttggaaggggaagcaggcaccttcttcacaaggtgtcagaaaagacacagtgagaaaggagggaggaactggctaaacacttatctgatcttgtgagaactcactcaccattatgagaacagtatgggggaaaccacccccattatccaataaccttccactgggtccctctcttgacacatggggattatgggaattaaaattcaagatgagatttgggtggggacacagccaaaccatatcagggccccacatccagctctggatattacaactgaacatgggatttgggtggcaatacaaatccaaaccatatcaccatctcctacttctctattcacatctccttcctctctcacagaagttcctctgccctagaacctcttccttccggaagtcttttcttactacttcctttgaaggtgggactcctcttggaatgacataactacaaccctcctatgcattactaagtcaaaagctatcttccccagaaagggcacttgttattttccctaagctatgcctgaatactttataccttgaattattattgttcataaacatgtgtacccataacaaattataagcttttcaaggaaggccctgtgtttggttatgattaattttatatattgctacaatgccagattcataatgagtttttaatcatttttttcaataatgactcatttaagccttggaatcatagactcagggggcaatttaggtgtgcctatcaaaatgtcaaatatttttacactttaacatataattccatttgaaaatacttaaaaatactaaaacctagtcacaaaaatgcatgcacaagtctgtgtattgttgcattgtttgtaatagtaaaaacatgtgataatgtaaaagtccattactggctggtggtgaaatgaatcatgatacatctgtgttatggaatattaatgagctgtgaaaaagaatattgtagatctggatgaattgatatggagacatctttaaaacttcgtattagtagaaaaagcaagtttcacaaaaacattcagtgtgatcccaatcagattaaaatttacctatgtaaattcatgtcaacagttctggggataagcatatcaaactgctaagaaatatgtactttggggtgggctggaagtttggagactgaaagagatttctgcctttttattctgaaaatacttcttaaaaaatggtggcttaaaacaatagactcacaggacatgaagattggaaggggccttatagggcagaggtggtgcagaaccttccacaggcagtattaggttctttgcatatatttcttacctatatctcataacaaaccccaacaggtaaggttcaacaatgccactttacaaacaaggacattaaggttcagactcaaacaaagcccgcctaaatctcaaccttgtccccttctttccaaggttataacagtacaattctaaccaaaattttattttttagataggactttgagacctgttcaggctcagccagaagtctggaagtccttcctgtgctgtctcttctaatcacttctaacatctggaggttatcaccacagccagccaatttgttcactgaaggacagaagctttgcattctgtttcttcgcccccaggtttgggttgatcatggtaccagatgctccttaaccctacaatgagatagtcactcttggaggggccaagtcagctattagacggcttctcttgatgcccttgtctttacagttgtcctggaaaaaccagacttctgccttaggcagagtggttccatttgaagttatgagaaaaggtgagtgaggagtagatagctatacaaaactattttgtgatatgacttggtgttctttgatgaggcttggcagagacgtacaccaactttcctcagcttttacccctggagatggagatttctttagggactcagatgagtggttgttctgcattagggctgggaaaatctcaaaaagagctggagggtggaaatgaagaattcaacttggaatccttaaatctcagacttggaagaaagctcagcagaggagatttaatctaacttctgacccatgcaagggttctctctggagtgtccacatagagcacaccttgctccagtgccagggaactcaccacttcagtgttgaacaggtcttactaagagaaggcacttgctgatggtgcctagatctgtctctccagaagccatctcccatgtgctgtggagcagggccctgaggtgaaggcactggaagcttctcctcttgttactggaaaggggtcccaatccagaacccaatagagggttcttggatcttgcacaaggaagaatttaaggtgaatccgtaaagcaaagtgaaagcacgtttattaggaaagtaaaggaataaaaaatggctactccaggctaggcacagtggctcaagcctataatcccagcactttgggaggctgaggcaggaggatcacctggggtcaggagttcggaaccagcctggccaacatggtgaaatcctatctctactaaaaatataaaaaaaaaaaaaaaaaaaaaaaaacttagctgagtgtggtggcacgatcctgtaatcccagctactcaggtggctgaggcaggagacttgcttgaacccaggaggcagaggttacagtgagtagagattgcaccactgaactccagcctgggtgacagagcaagacttcatctcaaaaaaaaaaaaaaaaaaaaaagaatggctactccattggcagcggtggcatgggctgctcagcttcttatacttattgttacttctttattaattatatgctaaacaaagggtaggttattcatgaattttccgggaaaggggcaggcaattcctggaactgagggttcatcccctttttagaccatataaggtaactttctgacgttgccatggcatttgtaaacagtcatggtgctggtgggagtgcctcttaggatgctaattcattataattagcatataatgagcagtgaggatgaccagaggtcacttttgtggccatcttggttttggtgggatttggatagcttctttactgcaacctgttttattagcaaggtctttatgacctggatcttgtgctgacctcctatctcatcctgtgactaagaacgccttaaccttctgggagtgcagcccaataggtctcagcctcattttgcccagccccgactcaagatgaagtcactgtggttcaaatcttctaacactctgactagtatacgacttccaaacaagtcactcttgccacttaggagatctgagctgagaaccctcagaatcaaatcccttattttacagttgggaaaaatgaggtccagagagccaatattttattaatatctaagtctcatatacccatatttgctttcttaatataaaagaatcatttcctgtcttacagttaacaaaatatcagatattttagtacactctgctcagagctacagcccctgcttagtcatcagcactaccaccactaccatcatcatattaataattattcagtgtctcctatgtgctaggcattctattaagtgttttacattgaatgatacctcttgagaaccttatgaggaggagtgaggagtctcccagttagagaaggaatgcccacctatcatgatagtcatttttcaagtagctgtgtaatggggcagaagatgagcttcttcctgctagatttcatcacctggggcttgtagtctcagaacaacagacaagtcaggctccttttccagtgcctggaaggacatgcagatgtatgtgtgtacacacatactcacatgtactcatacaggctctctgctacacagatacgataaaggaagcttgggtctgtctctgggaaccactctcttattaggcattacctgcagttcctgagtacttcttccagtttctcagacaaatctaaatagaaaccctgctactcctatttttccatgtgtggggggtggggggatgaacatattgtaggctgtgattaataatttaaaaaattattaagaaagatcaagcttcctgatgttcagcttagaccatatgtacctcaccttccctgaactatccctgtcctgcccccatatgcaaggagatacacaacacaacacacacacacacacacacacacacacatatatacacatgcacacatgcacatagggatgctcatacattcaaaaacatccagtgttccttcactgcctgtaaggtaaagctgaaacactgtagcctgaacatatgaccctttatgatttaaattccatcctttcttctgaaactttcttcctccattccttatcatgctccatccaaactggtctactgtgcatgccatcccatcctggcctcccagaaagctctttctcaggtggtgcccctgtttgtaatgttgttccctgtatgatcaccaagaccaagttcaaatactacagtgtctaagaaaccatcaatgatgtcttcaagcttcctgctgtaacctctttctcatcagagctcttaaaatcattttcaaaactgcttcaaaaacatattgatttcaataatttatgcagttcccttaatcgttgccaccccctgccactgcaagttagagctttctttttggtgcatagatctctttggtgctatatcttctatagccttgccagcttcatctgctcttgtagaaacttctctgctctttcctccttctttttggtccctgccttcatgttatcgagttccatttcaacctctttaccttgataaaacacatgtacataattttggcattgctattgtttttcactggagttacaagagatgtttgaccaatgctcataataatacatctagccatgctgataataatttaaatatggcatttaattactaagctccaggcactatcttatggaccttatatactttgcttcatttaagtcttttccaggatcgtgagtgggtaactcttttaaaattcctattttacagatgagaaaactgataactgaataagttaactcaaggtcatccacagagtgacacggctgagatttgaactcatgtgtagctgactccaaaacccaagttcttaatcactttatcagaaaattaccaaaaggcatctaattagttgcatgcaattaaatatatatgagggagagggccatcaggagattatttagaaatagaaacaaaataagatgtatgaaaacaaagataaaagcaagaacagttgaacagagtctgagaacaatgaatcgtggtttacaagttttagaaaaactaattagctggaatatagcaaagaggtcagctctgagacatctatccttgagaaggctaaggaggagtaccaaagaaacccattttcattgcagattgcagaaaaccttgagcgtttcactgaggaatgtatgtggcagggtatctctgttgccttccatccatacctctgcttttattggggtggtctccaccacctccctcatcagaacctctccctagggtgcatggcttctgatctcccaaaagactggtttctactgttaaaggagatcgtgcatgtggagtccttaacaggtgagacagtcacatggccatcctgaaataaatgtagagccatgataagccttataatcacggggtgtcttgttttcatatatttatcattactaacaggaagctggtgggttttgctttcctggcttttgctggtgttgagattccttttttaaccagctctggtaactcccttatgtaacaacacatgcataagtattcacacaattcactgctttggattgatcagctctatctatgagaattgtcttggccacagtgaatggattatagttacaatagaagtctgtactaggtggtccttcttttgacacttgcggactcccaaggaatggtggctggactctattaggctccaaactctcatgtgcctgagcgccagctccctctctaaacataagcatctcggggctggaggtggggggaaattttctgatgcatctttctttgccatgtaattcctaccccaggatcatgctcacataagtgttcttggaatatgtgagtaagtgactgaaaactccattgtactgccctgttgctgcataaaactggttgtcaatgccgacagctccctgtggtgtttttcttccctttgggaaatcacaccaatttagctttggctactgttccctccgtataccctttcatgtgtatgcaacaacccacagtatctcctccttgctttcaacttgctagagaccagcctttctcatgacactccacagcttgactcagcttccctccctgttgctatccctgatctcccaactgcctccctcttccaaattatgtgaaaacaacgaccatttactcaatacctactacctggcagatgccgtatgtgaaaaacctttctgggtcctcataacagcccccagggtaggtctaccagtgtctattttacacatgaaaaaactgaggcacagagaagggactttggaagcctcagagaaacagctgaaatgccagtcagctgtgattgacaccaaagtccagcaatttaaccattacagtataatatatctttaaatagaaattccaattacatttttcagatattctaaaaaaattccacatatagatttgaagactaatgggcagtcatacacccctgagctcatgtttactcagaaatctttgtcgtaacagctgttcctcccctaaccttgtatgtacttccagtttctgcagcagatactcaagcctaccacgtgcaagggagattgctgggcactgctttggagcaaagtgtaatatgttataaatcatacactccatgagtttacaaaagaacagagaaatgaaggggaagaaagaaataaaagaaaactgtattaaaagagttgattattagaaaatgcttagaaaggcaaagacttgtggaggtacaaaggaatttgtcaggtacagggtaaaaaaaaaaaaggatgtttacctagctgacctgtaagttaaacactgtattaagggcgttcatagcaacagtggccattttaaagcatctattatgtactatgagttttttatgcatttttcatcccttcacaagaagtgaacaaaataggaattctgatctctattttacaaaggaagacactggaagcacagagaggtgaaaaaaatcacttaagtgtacacagccattaaatggcagaatcaaaataagaatccaggcctgtcgtggcctgcatttctggcattcctcacatacgcctcccagtgggatccagcatattatccccatttacaggtaaagaggaagtggcagaatgtcagtgttggaaaggacttgggaactagaatgcttgtttaggggaaacaaggaaggctgtgtgcagatgtgctggacctggaaggactaataggacttagtacacagacactgtaaaagcattcttgagagaaaggtcttcatgagaagaggcggaagtgtggcagatgcaggacgaaaagaagatgccactgactagtgtagcagcacttttaggctgctggaagctgacatggctggaatcctaagtcaggcctagctacaatgcattcctttggtatagattatttgctttgaatcaagggtattgatgctgcagagtcaattctgcaggaagtgaaccctaaggagaggcactgagactttttttgggagatcctaaaaaagccagttcacctgctccaaccacgaggcacatttgctcccaaacattgactctgtgctgcatcttggaatattttgcacgtatctctccctaacctggagaaatacagtccatggtgcctttgggaaacaaaatagcacttcttccccactatctcatctaaacaaccctttgctgactaattgaattactctggcccacaaactgatagacagctgctaaaaatggttattgcattattaattcgctccagcaatttcacattaaacctatactgttaataatttttccccttctatttcttccctcttaattagactatttaaaactttgaaggaatagtctttccatgctaaatggaggcatcgggcaaattacatttttgattgaatacttctctgataggccagcaaatgagactgttgagttgttaattattgtcagagttccacacgacacctgctaatgaggcagtcaatctcagctgtcagtcccctgatactaatggaggctgatgggatgtactgggaaggatgcttgctggaggtccagggtgtccagttccctggctgtaaatgcaaggccagtgacttcccaattgctaaagcaaatgggaaactgtgatgagtggggaaggggatgggcagtggaacagaggtgaggacagccaggtgaggagagcaccaggtgggcaccattgggatggaccactttgttgttgttcagtaaatactgctggtatttttaatcattgctgatagggctgtgtgtctgcagtttcttggaaggtgatggatataaggaggtgcctattgagcagtcagaagacttcttaagacccctgacctggactctgaatgacctagccccaggctccagaagatgttttgaattttcttccttatgtaaccagggttatgctggtgtggactgagagaggtgtcaagtctcattcagcaagactgggagtgaaaaaaaggggatggcacccaagattgggtacccaagaactctatatactttttaagcagggttatgctataactctatatacttctgagcagggttatgctggtgtggattgagagaggtgtccgatttcattcagcaagactcggggtgacaaagaggggatggcatcaaagattgggcacttgggaactctatatttagtctgggacaaagcaaaagctcagtagaagggcagggaagggagaaaaattggatttgactaataaatatttactgagtactttgtatgcatgataaagacttaagttgtctgtgcaaactcccaaggcagacattttttgggaatcatccttgacctttacagcgtctacttcacaactacccacttcccccgcccctccattagattgcttcctgaggctcatggattctccttcaccaatgcttcggaaactcattatcttctccctctcaatttttcctcctccaggcccagtccttcccatcaacttctgggttactgaccccaatctaattattgctgaatctacacctcccaccctctgccaagtgacatcttcgacctcatctcctactactcgccccagcttatgcagctctccaacatgccacgtacactcccctgctctcctctgagcttttgtttcaccatctctagaacagggcatcaacctgctgtgacgtacctggcagggttctgatcaacacacactggcttccttctccttgagcctttatcgctaagcctcatcattcaaactgatctttatgctttcctgccatcggcctatcccttcgagcctattcattttattatggtggagacatgggttgtgggtggggatggggaggttggcaaggaaaggctagaacatccctgtcacaggtgcgagtcactgccccacagggagacttccctctcatgggggaagacatgaaggcagacccctaacttgggaggggcatcaggcaacaaattattgaattcttatgagttttaaggcagattcttaggttttactttgcaactttgtgggggaatatagttaactacattgagcaaaagattttaacttctgaagatataatctggccactttgttaactgcacatcgatgccacaagtgattgttgacagattgcaaggtactggacactgtcttaggagctaagatatcataggtgtcaaagcaggcaggatctctgcccatcaagagcatatattctaatttgggaagcaaagggccaacgagtaagcaagtaaatgttcgataatactaagacatacaaatatcacatctcttgtgtaattatgaggcatgggagtgatggtggtgtggggttgagtaatttcaggaaaatattaagaggtagatttgagctgagatcttaatgaagagaaatccaggtaaatgaacgtaggggtagagagagtaagcatccaggcagtggcaatagcaatcacaaagggatggagaagaatatgagcttggatagttgcagggtcagaaataacgctggtttggctgaactgtgagaatgaggggtggtagggggaaggggtagtagagtgtgagtttgaagagataggaccttagaggccatggtaacacacttgaatatgatgccaaggccaatgggaagctgctgtgagtttaaagcaggggcatgacatgattggatgcaggtgctttctgaagattactatggagcacctcttatatgtgaagcccggtgccaggtggtggatgcacaatgatgaagtagatacagacatcaccttcttagagtgccatctaacaatggagacagacacacagccaggtatctgatgcaatacaaggacaaacagcctggtagtggaccctaatggctgctctttcctctgatagtaatagacaatttcattgggtttttggcttccacatttcctaactttccctgaagctgggtgtggctgtgagattacactgtggctaacaggatatatgtggaagtaagtgatagcagctccaggtttcctccttcagaggcagctggttctacattctgctgctcttccccctgcttccatcctactgcttcaaatgtggatgggagagttacatgcatgtgccctggaacaccccatgagagctagacatcagggacgcaggaacagaaagctacaggaacctggagttctgcatggagcactccatgcaggagccattcagttctgcatggacacagtaaagagctgcaattccaggccgggcatggtggctcacacctgtacttccagcactttgagaggccacggcgggtggatcacttgaggtaaggagttcgagaccatcctggccaacatggcgaaaccccgtctctactaaaaatccaaaaattagctgggcatggtggcacgcacctataatcccagctactccagaggctgaggcaggagaatcacttgaaaccaggaggtggagttttcagggagccaagattgagccactgcactccagcctgggtgacagagcgagactctgtctcaaaaaaaaaaaaaaaaaaaaaaaagagctacaatttcagtcctaggttgttacttctgtacttttacccaaaagacaaatctccatctcatgtagaagcaggctctattttgggtctatgctattgtagactaatttaatcctaagagttagctgtactaataaagtgttggcaggagagggattttttacagacattcaaaaagaaaggaactaactccagcttccttaaaacaaatcgagcacccctcctggattcttcttattacctactcttcatacctcccagtcaatgctgtaaaattggttgagactggctttctctgagaactctggatgctgatgttttttgttttcttgtcttccctctagtctacttcaagcagacagaaggggagccggagtgaaggtgagtatgaggcagtcccttcccgcagagaagtctggagattctgcctcatgtttatgagaaaggcaagccaagacaagtttggatgggaaacaggagcacttaaggaattaaactacagcattcatttcacaagagggggaaaagatggagaggaaaacagaatctaacaaaatggagatggcaacccctttaaagctattacttattggcaaggattgttcctgaattttattaaggaaaaaaaaaaggcaatgaaaattcagcatttactaaaacactaccatttaaatggaataggaagaacataccaattatgctggaacccacatgagtctgtacaggatgctacaccaggcaaaaacaaaaaacaaaaacaatactgacaggatgatgtggatggcctgtctgactgttctggactgctctgtcttctggctaaataatgtcttcaggcagagataacaataaaaaaatttaatacttggtaaatggagggtaccaccaatcagccaatctgaatatggtggggccctggagacctcagttgtgcgaagtgttagtcctttttttttttttttttttttttctggatcaagggcaggtctggggagtaactagcagagggatggaggtgatcagggcacttgggggctcaggcagcagctatttaaaaaccaatccagatgcaattcaatattttaacaaaaccacacagtgtgctgttgtatatttgccgaatatcatcagctccatttccacaaatgagaagctactgctccaaagaggtgcctcgatgccttggatcaaagaagcccgatttcttttctcaacagtcacagaggtgccaatgttctgcaaattttcttccaagccccctaatgagcccaggagtccccatcaggagcaatgccagctgcaactaatgcacacaaaacactttgcaattaacagagtcgagtgtgtcattaagacaaccttatgaggaagacaatactcccaagtaagcccggaagcataatgaagctaggaggctagtatacacctaagtgatggccctatagcaaaatggcttttttgcttagcaaactaacacaggaacagaaaaccaaatacagcatgttctcacttacaagtgggagctaaatgatgagaacacatggacacatagaggggaaaaacacacactgaggcctttcagggagtggaaggtgggaggggggaagaggatcaagaaaaattactaataggtactaggcttaatacctgggtaataaaatctgtacaacaaccctccatgacatagtttacctatgtaacaaacctgtacttgtacccttgaacttaatataaaagttaaaaaaatggcttttgaattcatttagctccactgtctgaggcatggcacagacaaatgatggttgttccgtgattttctgttgatgtttatatacccccctgtccatatacagtggctgttgtagaagcaggtttggttgcctagagtcaggttgttacgtgtgtacatcccagctgttttcccgttctagatgtgcaaactcagggaatgttcttaaactctctgaacctttatttttcttacctgtaaagaggttaggggagtactatttgccctgctaggttgttgttaggagttacgcattaggagtaattacaaagggtgccaattaatggtaattcccttagcaaatcttcatgtctgtgctggttgaacatacacttctaggtctcacattttaaatgaaatagatagcagactgaattccaacaagtccatctcatggttcaatacatagaggatttgaggctgagagagtccagtgacgagaatatgggttttaaagttctatataccagaatatgagtcttatcccttctgtttaaaatagctgtgtgaccttgggcaagtaacttaacctctctgaaccttatggtctttaacataaaagtaatactgcctacgttatgggaaggttgtgagaattaagtaaagtaagctatgaacctagtatatagaagacactcagtaaatgtgagctttttaagacatttctgtatttccagaagcatgttcctctgcaagtcacaaatggactttggcatgagccagaaaagaaagaaaaaagcaaaaagcaaaaaaaagaaaaaaaaagacttccagtcacacagtctaaagcactggtcttgccatctggcagaacaggattcaaattccatttccatcctttacttgctgtgtaatagaggcaacttacgtcacctctctgtgtcagtttcctcaactgcaagataaggaagtgatactgcctgaacttgggggtatgtttacatgctccctcttgttttgagcattaactagttcatgtatttgtttagtacgatttatgtttaccatgtttcaggcaccgttatcacactttaccatctcagcccactaaatttaatctttatatgaacctttgaagtaagtactattactattcctattttacaggtgagacattgggaaagagatgttgagtaacttgcctgggtcacatggttagtgaatggcagacctgggatttgatcccactgcattctggctttggtgtcagtggtcttaattaccgagctgtggggcaactaacatcatcaccaccatcaccactaccaccaccacaccactaccactaaaaccaccaccactaccaccaccaccactgccaccaataccaccacctccatcactaccaccaacaccatcgccaccaccagtaccacaaccatcaccatcaccaccaccaccactaccaccatcaccaccaccaccaccatcaccaccaccaccactaccatcaccactaccacccaccatcaccaccaccaacattccaaccatcaccataatcagaattataaccactcccaccactacaatcacagccaccactacaaccccaggtactgccaaaccacatttattgtgtgctgatgaggtgccaagcactttacatgcatggtctcattgcattctcacaacaatcctatggggtaggttaagcaatttgcccaaggtcactcgatcagcaagtgctagtacttgcacttgacttaggtcctctggtcaccaaacccatgctcttggacactttattagattgctgaaactgcaaaaagcacccaacatgtcatcaggcacataactaacattttccagagacatttctctcttccaggaattttcaagctgtaaagtttgggttttctgacagcccttgagcacttcagtatcaatcttttcaccttgtctaatttgaagggtgaatctggtggcttcagatgacaaatgaacccacacacagcttcacctcgttctcatttaccaaaactctgcccaaggcttggcacaccttgtttatgtctttggaaaagaaaaaatgatgagcaaaggtaggtggcagagccctgtctagctccttaggggctggacaaattgttagatgtgagagcacattgatgggaaacataggactctagggccttgaatataagaggtgtgaaggacccttcattgtttgaattgtatgtgtcggatttttaatttggtttaactttataaacacaggcctggtaacttatgagaggatcctgggctcagccaatgctaggacaacaaccttgatttccccttctatccatctttcatactgagctagaataatggttctagaatggaggtctggtaattctttttccgccttaaaatgctttcatggtttcagattgccttcaggagaaagacaggacccctgaacataatctaagaggctcttcatggttgactcctgagcaaccactcacccctcagcttccttctcccacctccttccttattccctgtcaccacccatcactctagtcatccagggcaatctgcctgctcctgaacatgttagatattgcatcctcttggtcttcttctgactctcacacttccctcagatctcatttgggacttcattttcctctgggacagttcacatctgcctattctctaaacctttatttactggcactatctattatttctctaccaaggccagggacttgtattctctactgcctagcccagagtctgacacataatgagtaggccttccataaatatctattggttgaatgaataaataaatgagcatgtccaaggatcaagttcaagaactacattacttttgggggagtgggtagaaagatatgcatttgaggtttaggacaagaaaacattgcaaaaggaattgaaattaaaaaaaatcagtaattgttctctgattcctatttgaccctggtattatacataattaatttgataaatatgtgttagtttttactgaattgccaagcaacatgctgccctcatctgcagagataaatgtgacatcttttctgccttcataaagttcactgtctaacatgggaagcagatacactgaaactaagctcacaaaatatctgtcagctgtttgaagacatactgtgtaccaggccttttcatacataatttctaattttctcggcaacctttgtgagataggcattgattccatttttacagatgaggaaacaagcacgcgaggtttaagttggtaactttcctttgttcaatcatgcagtggagtgacagaaatatgaaatgacaacttcttaacacctgtggtctttctactatactaccttacttcaccctctcctgtactgtaatacactagaataccactttgcacatttgcaatcatttttatgcatgccgcctcatgtcagtgccatgaagcactgtttgcaatggtagagaaggatgctaatacaatccttggttgacaaatgggaaaactgagaccctgaaagttttggtcctatgttaatgcaaatcagaacagaatcctggtttcctgatggtggagacttttccttgttactctaaaaatacaccctccgaaatcatgcacctccagttccaaatacgtaactcctttggtccacaaggagcactgacattacctccccagggcggatcaacggcactgcccttgagctggctgctggcagtttcacaggccccctgagtcctcaacaataccccccactccaaagcagtgcttatatgaagtttgatttcaggcctttatccaattgctccccactcagctagctgaaagggccctggagatcatggccagccctttgccccatttgaggacaatgcattggcccaaaacacaacacattatctgggcttcaatatattatcacaatattgttttcttcagactgataacaattcattgctttaagtacacaggggcataattccaaaagagaattgattatctttctgagataactcttgctattaaaaaaagggaatattcccaggaagggatttcctttgccctccttgtttctctaggtcttatttccacaatttaactcaacaaacatttactttctttactatgtgccaaacactgtgttaagatttgaaaggacaaggacaaatatgaataggacacttcctattagggtacccactctgttataaaaagaaagatgtgtgaaacagtagtactaactcagaaatgctggagaacacggtggtaatcagctcaggctttgctggtgggccagtcatgggttcaaatcccggttctgtcactagctggtacaattttgggccagtgatttaacctcatagtctcaattttctcatctggcataatgaagacagtcatagtgccaacactgtggccttatttaacaatgaaatagtagctagctattagtagtagtagtagctatagtaagatacatggtagctagcacacagaaaatactcaataaaataatcacttttattataacaataaaattattgttttattatttaaataattttaactttaataaaatatttgcttttgttatttaaaaaatttattattattatcattattccaactcttctgaccctccaagagtcaccctggaggacaggcattatatgcttttcttctttgtaactccccatccttcgtgtctaccaaagggctcatcacacatttgattctcaataagatttagctgactgtattttagacagatacagctaaacagaaataaaatcatttgtgtcattcttttgtatttttttttccaaattgagctaatcacacacacatgcaaatcttgggtggcaaaaacctactatgtacaggcctgttctgagtgctagagagggaaatgaatacaataccaatgtggtctcataaagctcacagctccacagtgaagggaagcagtcagttttcacaatgactcaggtggaaaaatgataacaaatacgtcatgggctgcatgatgacgtttccgtcaaccatggacaaaatacatgatggtgaccccatagcatgacaacagagctgaaaaattcctctggcctagtaacattgtagctttcctaatgtcctagcacaatgcattactcacatgtctgtggggatgttggtgtatgcaagcctaccacactctctgttgtataaaagtatagcacatacaattatgtacagtacataatactggattatgataataaacaactatgctactggtttaagtatttattctactatacttttaattgttatttttattattttgtagagacagaggtctcactatgttgcccaggctggtttcaaactcctggcctcaagtgagcctctcgcttcagtttcccaaaacacagggaatacagttatcagccaccatgctgggcctttttattgttatttgagagtgtagtcctactacttattaaaatcagttaactgtaaaacagcctcagacaagtccttgtaactgtaagacaacctcagacaatacctccaggaggtattgcagaaaaggcattgctatcataggagatgacagctccatgtgtgttattgtccctgaagaccttccagtgggacaagatggaggtagaagacagtgatattgatgatcctgattctgtgtagtcctaagctaatgtgtgtgttcatatcttagtttttaataaaggagtttaagagtgaaaaaaactatttataaaagctcatagaatgaagatgtaaaccctcatgtacacccatatgtgtgttttaagctaagtgttactacaagtcaaaaagtttaaagaaataaaacataaagttttagtaatctaggtttattattgaagaaagaaaattttaaaataaatttagtgtagcctaagtgtacagtgtttataaagtccccagtagtatccggtaatgtcctaggccttcactttcacccactactcactcactgactcacccagaacaacttccggtcccgcaagctctactcatggtaagtgccctatacaggtagataattttaaaaaatattttaaaatttctactgtccctgttctatgtttagatatgctcagatacacaaacatttaccattgtgttaagttgcctacagtattcagtacagtaacaggctttacaggtttgaagcctaggagtaataggctacatcatgtagccttgatgtacagtaacctttaccatctatttttgtgtaagtacattctttgatgtttgcacaatgaccaaattgccagacaatgcatttctcagaacaaatccctttcgctgagtgacacatgtctgcagaagacaactgaggataccagtttgagatccattaagacttggttatggcatattgtttagcatggtatttgactctgctagtgtgcttagaattttctggtgaattatcctgggataatctgggatacttgtgattctggcctgacttttttttttttaagtcttttattctggaataattttagatttacagaagagttgcaaagatagtgcagataatttctgtacacctttcacccagcttccattcagcttaacatgttacataactatccaggaagaacagatgtcctagtttgagggctgccagcaggagaatcccctcttactcagagaagggtgagctgcttgttcttttcaagccttcaagtgattggatgagactccctaccccccacatcatggaagacaatctgctttacttaagctacagaaaaaaaaaaaaaaacaacttcacagaaacacctagaataatgcttgacaaaataattgagcatctccatgggccagtatagttgacatataaaattaaccatcacactctagtacatttatcaaatctaagcaattaatatggaaccaatactatgaacaaactacagactttctttggaggctgatcattgttttttcattacaacagccttacgcagaccaaatgacctcagtgttagataccagagttgagactattggatcagtactaccaaaaccaagcaagatagccagacgacatgagcagagaggtaggaagaacactgggccagcagactacttgaattctaatcctggctttgctactgaaaggccctgagtcctagataagctaaaaaaaaaaaaaaaagtcccttcaagctctaaaagtctatagaaatttaagagggaaagtaaaatatgtatgtgcatgcaagtgcacgtacgcacgcacgcacacacacacacacacacacacaccacacacacacacacaatgtggtcctgcttctctgaggtctctcctctacccagtgcagtgcggcaacgtgggataagattattatcactcaggccctcagatctcagtgctgataagttcagctaagcctaggccctcctccaactgcagctaaccaccgtctcagcccaccttgaacctccactgaactcaccattctgatctcccagcaagacgtggccctcttctctgatctatctctcttctctgatgcctggccttcctacctcctttagggttggtggcttctcattctttctgctggtttttatgacttggtcattggcccggggagtcctgggtgctagattgagatagccctctgtaggatatggtccctgccctgcatccagcttcaaaatgtttatcatatcaccacttgtattttaggaatatgtgcctgcaatgaaagtcctccctttcttgcacaaggtggagcactgatttgctgctcatgtgcatgtgtgcacacacacactcaacctgaaaggaacggatcgtgagggcttccctgagcaggtgtcctttctgcatataaggaagctagccagaaataagtggtgtgacatttagggaacatttctagatgactttcagatgaggaagattgaaacaataagaggccaagttcagcccaataaaagcaaggacttcagggaacaccagtcagccttagcccagaggcagcaatggcagaagagtgtgcagctgatgcacatgacctataattgccaaatgggcagtgataacttaaagcctttatattcataactctcctctttgtggtcccatttcacatcctcttctggatggttgtacactacagaaatgtcagcacatttccactgagggggtgatggcagaattagaagttattacgtgtttgagtttcttaaccatattaaatctgcacctactatgtaccaggtcttgttgccagtagttatagaccggggataaaaagatgaataaggcatgattctaaacatcaaggagctcatagactgaagggaaggggcaaatggaaaaaccatgtagtaaattgtgtataaatgctgggctctaggggtgaaggggaatgagtgaagaaaccagcactcctggcacacctgtgagtataaagatgtgaggttagtgcccacactttcagctcaggctcagagtaaagagacacagatactcattcctactgctagcacctttctttcttccctaacctgtaagactggaccccaactagcctgcttacataagtatctacaattcaacctgtaatctaaaaaagccagattcagaggttctaaaattagatattggtaatggttacacaactctgtaaatttacccaagctccttaaaaatgtacatttaaaatgggtgactgttattgtatgtacattatatctccaaaaaaagctcttaaaataaggcagattcatgttctggatgcatgtaggattgtgcagtactgcagatcaaaatcatcacggcttccctaatttccccaacataaaatccctatctttggcctgacattcaaaacactgcaagaagtaagcctcaactctgggcagtgtcttgtgccttaaatgtgctggtctcctgcatggccagcatgttccattccattgcaacgcattctgtttctttccattctatctttttccatattatcccatcccacaagattttgtttgcctctttgtttgttttaagaacttactttagcaatgcatagctctatgatgagtactaaaaatatagagatgaagaaaacaaagttctgccctccaagagttcacaggtgcacttgttcattgtgaagacggatatagaaaccgacaattacaacaataatagccaacattaatgtagtgcttaccatgtgccaggtactgttctcggtgcttttataaatatgagctcgtctcatttttataactaccttatggggaagtactattattatctccattttacaaaaaagagaactaaagcagaaaatgattaagcaaaatgcccagcgtcttaatatgagtaggtagcagagctcaaatttaaatctggggatcctgcttcctgaattcatgctcttaacctccatgtgatggagagatctacacaaatcagaggtagaaatatttcccaaggaggtgacatctcagctagttttgagagaggagatgatgagaagccatgtgccacacagacatgggagagaagatcaattaaaagcagatgcaggccaggcacggtggctcatgcctgtaatcccagcactttgggaggccgaggcaggtggattacctgaggtcaaaagtttgagaccagcctggccaacatggggaaatcctgcctctactaaaaatacaaaaattggctgggcatggtggctgcatgcctgtaatcccagctacttgggaggctgaggcaggagaatttcttgaacccaggggacggatgctgcagtgagtcgagatcatgccactgcactccagcctgggcgacagagtaagactctgtctcaaaaaaaaaaaaaaaaaaaaaagcagatgcaaagatatgaatgtacatagtagggtatgtttgggaagccataaacaatttaatgtggctgaaatgcaaaggatagggggcaatgctggttggatatgaggcttgagctgttatgaggaactggattacatcagattgaggtactgtatcagttaggatgtgtttggcctaaaagaagcagaaaagcatgaccaaaactggcttagaccataaagatatgaattgttgcttatatcagaaagtccagagatagtaaggatttcagagtcggtcaagtcatcagctcaactgtgtcatcaagatctatcctttccatctatccactctggcatgttcagcggtggtttatatctcaaaatgactccgttcaaggtctcaagaaggcaaaatattttcaagattcctagccagatgtggcaaagttcaaaatcagtgagcaactataacagtgtatccttcttaagagaaaggtgaacttttccagaagacctcctcctgtcccactggccaggactgaggatcacgtatcaactctcacaaatcactgggaaggaaaatccctatattggtttagctcttagaaagggatggggctcacctttccctgagtcacacatgcaaatggtaaacatttgcaccaaattcatgttctgtgagtaatgaaatggggactgaatgtcaggcagccagtgagaataaaactcagccttttaacctaaaggctatgaaggtagagggtagggaagggcaggataccaaagttaagacaagtccaaactgaggctgagaagcaatcttttattcatacattcattgccttttagcactctagcctacagtcacatttcttcttttcttcctttccttcctctttcattctctttatgtttctccctttctccctcccttctgccctccctcccttccttccttccactttccttctattaaacacaagtttatcaagtcccacatggtttattatttggccaatatttttcttagtgctgctggaatcacagttatgaacaacacacatagagttctggatgtcccgtgttttgtgtatcaaggagtctttgtttcccttcaacttaccccatcccacctgtattagtctgttttcacactgcaataaagaactatatgagactgggtaatttatgaagaaaagaaatttaactgactcactgttccacagaattaacagagagcataactgggaggccttaggaaacttacaatcattgcaaaaggcaaaggggaagcaaggtcctccttcgcatggtggtaggagagagagagagcacgtgtgtgcaaaggaggaagtgccacacttacaaataatcagatctcttgagaactcacttactatcatgagaacagtaagacagaagtacacactcatgattcagtcaccttccaccaggtccctccctgacacttggggattacaatttgagatgagatttgggtgaggacacagagccaaaccatatcaacacctcttcctttagaaagccttttatgaacatcccagtccccagtgatctctcccttctatcagagtttctactgtccctgaggctccccactaattcttatggagcctagtgtgaaaaaatgcagagacatcctgtggaagattctgtggacatcaaaagcatcctggaacaagggtatgcatgtttattcccccacccccaacttaaactcccctctccttctttcactgtctttttaaattctctgataacgattattggttttctgtagccaaagggcaaaattaataaattccttagctgtacaactttctcgaaatctaataatgatcactgagtgttagagctgagataaagaatgaggaccataaaatagaaacagggaaggagaaaaatccaatgagcatgctggtgtgtgaggggttgaaggggtatcaagcctgtctactccgggagtgtttttcgttaaggtcaggaatttgagcctttaagaaaaagaggaaggtctaatcttgggggcttgaggtgggaaggatgcagggcaggaaaagggtggggaggatgagagtggtaagtgctccaggatctctgtagaccaaaggattaatgtgccacctttatcttttaaggcttttccccatgccacccccaacctccataatgggaattgggactagaggattcaactagcctgagtggccacaagtacacatttttgtcaaaaaaaaaaaaaaacaacccagattgtctttaaatttctaggtgggaaaaagcaggacagagttctccaatgtgtattaagccaaagcaggttataaggagaggagaggaatgttgccaggagatatagactaacccttgatatttcttcaagggacattctacctgatgtgtattttggaaggcagtggggacttgaaaatggttttagaatctgacagttccttattttattccctgatccatcacctgttggacgtggggcatttggaagtcactcaacttctaagaaacttagtttcttactgagtgaaatgggattcacgttttctgttcattctgcctctgtggtctgttttcaagataatgaatgtgaacgtctcacagagacatctgagttaggctgatgaggttgttatttcttctgggaagatgctttttgcttcccaaagggattgcattgccaatctcactgagtaatttatgtgtaaacaactttgattttccatctcaatgactttctttttctattctctgtttcagcatatcccagatctgtatactccctcctaaaagcaagggggaataaaagttacatgcatctttttcttactcatgaggatatgcagaaggagatttctttggtccaaatttagctagcagacacacagactcattctcaaagcataaaatttggattcaggcagtatttttatagtcctggtcagaccaaggaatatttttccatgaaccattggagagtaagttgccaaccagatgccccattaatccaaacactttagtgctattttctaccaacaaaacagtctcatagataataacaatatagccatcaaaatcaggaaattaacactgattcatcactactgtgggatcctcaggttccattcaagttttgctgaatgtcctaataatgtcctttagggaaaactattcaggtcagaaccatgcgttgttttaataggtaatgtcttttagtctttaaattcagaatgtgctctcagtttttccatgtctttcataatcttgaagcttttgaccagcaacccttttcaatttgggtttatctgatgtttcttcataattaggttcaggacttacgtcttcagatggaatatcacataagtcatgattctttgatagggcattctatcaagtggtccatgattttgatttgcccatgagggtgatactcactttgttcattcaattaagatgttgtctgccagtcttccctactgtaaagtaactctttattcctttgtaattgtgaagtcctttgtggggaggtactttgaaattatgtaaatatctctttcctcatcaaacattaaatgtattcatttattagtgcatatcagtatcaaatggtggtttcttgtttactgactgggttatactatattaatataattatttattttgatgctcaacttgtaccaaatttgaccagtggcagtgtccccaagctaactcctaggtctttgaacatgtttccatacttctgacttgctttctggaacaacaagatattactggtataactttaattttccttgttgtagctttggagtcagccatttttcccaggagcactgattgtttttagtagaagtggtacttagaggccaagatctggatactacatatgctcattgctattgggtaatggagggttggggtaaggagggttgctgtccttgagccctttcagtagatagagtttgacttatatgtgtgagtgtgtgtgtgtgtgtgtgtgtgtgtgtgtgtaagagacagaaaaacagagacagagagagagagagaggagagaaataatttggtgtttttttttttttttttttttttttgagaaggagtctcactctgtcacccaggctggagtgcaatggctcaatatgggctcactgcaacctccacctcctggtttgagccattctcctgcctcagcctcccgagtagctgggattacatgcacacgccaccaccattggctaattttttatttttagtagagactgggtttcaccatgttggtcaggctgctctcgaactctggacctggtgatctgcccacctcggcctcccaaagtgctgagattacaggcatgagccaccatgcctggcttctttctctttttcaaaacagtaataagactagtacttctcaaaatatatcccggcaaactcttaatatacactctgtaaataaaagagatccaaggtcaaccaagtctggcagataccagacttctctgaggtttgaaaatgctcctgagcttggtggccacccaaagagctctagtatgtagcacctgtttatgatatgtcagtcccagtgctagaatgatttgttgcttctaagtgatataaactgatatatttttaaaaaatcgtacttgaactctccacaatatatttatcatcactgtatgaaaatatactagagaagtactgacctctctctctcttgccttttctttgttaaatgatgaaatctccttctcttctggggcggaagtaaagaggatgggctgagactgtatcagaactagtgtaagtggaagagactgggtgaagttgatgtgaaggccctggttctgcctgattgaatctttgtgggttggaatggcttgagactatgattgtgacttttaggggtacaaggtcaaattgtgaccaattctagaatttaatgtccaagtaggccagcctaggaaaaacaataatgaagcctacatttgtagcttcttggtgaatacactaagggctggttccaggggttatagagcctttattgctcagtggttgaagcaacaatctttggaatcagttggatttgagtttgaaactttctttgccctgtgagaaggctacgtgactttaagtgttaatataataattgtacctatctcataatgcgtttgtgaggattaaataaggcaactgtatgaaacacacttagaccactgtctagcatatggaaaatgttcaataaacagcaaagtttttcttttttttttttcttattttggtggtgattgttatttcagtatcagttatgagtttgaatgttctcttacagaggtctatcaaagaatatgcaaggaagccaggaatgaaagagatagctctagaagaggccaagctttctcaatcttgccagcattggtattttgggtaaaataattctttgttgtattgtttgttctgtgccttgtaggatgtttagcagcatccatagcctctaccaactggatgccagtagtaccctcccaggcaaggcaaccaacattgtttccagacattgctaaatgtcccttggggtggaggtgggaaaaattgttccaggttaagaaccattgtgataaaggaagtaattttccagtgagctgagaagtgggtagaaaatgaaggaacagaaatgacaaaaagaaagtagtcagttaataaatttgctgctgagggagggagggagagagagatatatattaatggataactagaggagaagattaagaggattattgttattgcaaattattattcatttttaataaaagatatggttggatatgtttaaatactgaaagaacatagcaaatactgaaggagaagttaaagtttgtcacgggaagttacagtttgtcatgggaagttacagttttcctttggcaagcttcccttccaccttattctggtaggaacaggaaacaccctccagccccccttctcttttcctttcatgtctagaattacctctttctcactccataaggctatagggaaaattaggttactaatatgtaagtaccctccctcctggccatagtacatgccagatctggccagtcatagcacctgattcccctttgcagtaagtgtccttggctgggacaaaacaaatccttccttggaattttatacaacatatggaggaagatagattctttctgtttcctttatgttaaagatgtaagaatgtgtctctacagctcctggtgcccatgccccatacctatggaagacacagaaacaatgtggtcaagacagagatgggaactgagataagacagaaagagatagagagaactaggccatatgtgatggctcacgcctgtagccccagcactttgggaggctgaggtgggtggatcacctgaggtctggagtttgagaccaccctgaccaacatggagaaaccctgtctctactaaaaatacaaaattagcttggcatggtggcgcacgcctgtaatcccagctacttgggaggctgaggcaggagaacagcttgaacctgggaggcagaggttgcagtgagccaagatcacgccactgcactccagcctgggcaacaagagtgaaactctgtctcaaaaaaaaaaaaaaaaaaaaaaaaaaaaaagatctgtggttgtagatactgccatgtatgagcccatctctcacacagcatcatcaccaatcatgtggaacagttggttcccatttatagttaagtcagttaggtttggttttggcatagactgtgaatagagtctacaaagataaaggagagggaaggtatgatcagtagaacaaggtccttcaataaactgaagtgcatgagatcagggtcaggcagagagatttcccttagataggaagcaagccacactctagagatgagtaggagagggtggtattggtatttggtggcagaagctatgggaggcaccatggttaagatcagtaggggatctgtaagcatgcaatcaccagcaagttatctatgatctcacttttctctcttccactcaaggtaacattccccaaacacaagtgggagatgttattttacttctaaggtcatatccattgcattttaaaaaatccctccaaaagacaaaatattttgaaacttgagtaattagactattattagcactacatttctgacaacttacctaaccccatagtttcaaatactaaaaatcagagtaacttgagtaatgtgactatttttgttgttacatttcttgggacttacccaataactcatgtggtcaaagcctgtgggttgtgccactatagctgagagcaactgtattgactaaaatcacaataatatgtaagcttttccattacttgattataactgcattactgtatttgtaactgccttttagtttattcttaatgctagtgagcacttgacatgatttgagagttgcagaaaatagcccaaccaccaccacgactttatgaatagtaatgcatggggtatgtctgactacttactctagacctaccatagacatgactaatcaattctggcattcattcctattgggctcgcatgcagccacagaatccttctcggccttatgctccagagagtataaggctggcctcaaagatgcaatgcatttgctattgttgattggcttagaagctcttggggttcattcctgttcatttcctggtgaagaagaaatggcctccaggatctggcaagaataagggccctggagcagccttgagcatctggctctcaatttccgcattctttctctccctttaagaagaggtgagatgtgatgagaggcacaggctgtgaggcctcaggcttttatctctggcaatgacatgggcagcgtgacatgcagggtaatgaattgccgtctttgcagaaatgaataagttgtggtcagtgatgaaatgatcaatttgctccatcatgttaagctgcccattcatcatccacacctgctgtcaggagcccagggccgctgatattggcctcaagcctcttcctcagctagccgagcaatcgccgttggagctgcctccaagctcaaggctgcctttgattacagcctttgaggaggggcccaattacttactgctcagccaccggtgactctgaaaacaagggacatttgtgctgacctgggctgttgacatgtagcctaacaaaatgtgaaagaccctctgacagggatccaggtggcccgtcttattgtcccacagtgcgaccttgggccaggccatgtcatttctgttccttagcttctctattataaaaggaaggggtggaggagactcccagttctccatctccgacccaatagatctgcaaatgtctgctatggaaaggacagtttgtgattttaactcccccacccactgaggcaaataacagcatttattagctgagattgtttggcagcagtgaatcattctttggcttaactgaaaataaggtgtaattatcacattttactgataaggaaactgaggcctaacaaggttaagtggggtgcccaaagccacaaagagaggttgtgttatagttacaattgaatctgtatctgtttgacttctaaacccttgcttttcccactgcaaattgttttggctagagagcaggctattaagacattctagccaagccaatttcctgagagttctgcaggtaccaggtgttgctggagcccagcatctgctcagaggaaggcagagagacccagaggaacccagaatgagacactcatttttgcatcctcagtttccaagttaattttctagctcctggttaggacccgaattacagagaccaggcagctgtccaacaagaatgctgacaggtttcattgtcctctagggtagctgctgcctaaagaatatttgattttttgtttttttaacaacaacaaaaaagatgggttccctgtattgagcatctcctgagtgcaaagccctgcactatgtgctcaacacttgatccttgatggtttaaagcctcaacagtgtgatcaggttagttgctcacattcttggatagaaaaactgaaacttagagcagataagagacttgtccaaggtcatttagctcattagtggcagagctgtagctcaatctgtatccatcagtcatctgtccatcaagtccagtggagtagaaggggtcacacaatgggctcagagacagagaaccttgtgctagttcacacccttgacctgtccatgtatgtatggacatgtaagcttgggcgggttacacagggcttggttttcttatctttttttaagggcttggtgttatttttaaaatagcagagattctaataacagcagctacctgttattcaactcttattatgagctggcattcaggtgtttcattttatttcatttctgaaaacaatcccatgatatagcatcattatccctattatatatatccaacaactgagactagaaagggaatataacttactccaggccacaatgttagtgaatggcagagctaggattctctgacctcgaagtcaaagttctcagctacttagttatacaggagaaatgtttcttaatattgaatgtgcaactaaatcacctggggatcctgttaaaatgcagattctaatttagtttgtctagattggggcctgataatctacatttcaaataagcaagggatgccaatgctgctggtccaaggaccacactttgagcagcaatgccctggaatctagttaaagcttgacaaactttttctgcaaagagccagatggtaaatatttcaggcttactgggccataagtaactactattactttgttgcaactacttagctttgccattactgcaaggtatcagtcattgataatacgtaaacaaatggatgtaactatgttccaataaaactttatttattaaaaaaaaacaggtgatgggccaaattggctcatgggatatagttggcaaacatctgagagagtttccagatcatttagcttccatcagcctcattgtcttttcacacccaccactctgaatagtctaatgcaatggctctcaaagtatggtccattgatcagtagcatgagcatcccttaggaacttgttagacattcaaatctgtaggccccaacccagacctactgaaccagaaaacctggaggtgagcccagcaatctgtagtttaaaaagccctccaagtaatggttatatgtgccaaagtataagaactgagaaagaattgacatctctgaaatgtaggcaagacctcgtgccttccacttttggcagaatgagaaggcacaagatgacagggatgaggactcgaagtctggtgtcagatagagctctattgaaatattggctttttctctgattagctttgtgaccttggccaggtggctgaggatctgggaacaaaccacagcttcttcctttgcaacaacataagaatataaagtgtttatgaaggctgaggagtcaatgaaatgagttgatgcccacaaaggatttggctcagtccttggttcataaaaagtcctcatgaaatggaaaccattgtcctcattatgatgaagagaagtcctctaaatagtcccagatggactggtatgaactgtcaaatggaggcaactgggggcttttgaatttgagagcagaaatagtaaatgagaccaaatatgttgtgactaaaaatattgcatagctattggcttagctgtttaaagggactaagttaagagctagccgatcctgttcacccttctgggcactctgtagtgaatgcttgtcagttattatagtaaaccttgatttgtatcttctgagcagggctctggcccagaagatgcactgtgtgcttgaggccctgctagaagtggaaaaattaccagctttggatccatgtaggcaaagatttgaacctcctgctgctctagcatctgactgtgtggtcgtagcaagttgtttcacctttctgggctttattttctcttctataaaatggggccagtgttaaaaacctcattgggttgttgtgagaattacaaatgttgtcatttattttttttcagtgtactgtgtaccatgcactttctgtggatataatgagcaagagaaataagccatctctgcatgcaggagtttcagcttaactggaaaactaaacaagaaactacagtcaacatgctatcatggggaaggacaggagtctctttccggagaggtttgtccagaatttcccaacattggctgtacagcagaacgaactgagagctttaaaaaatgccactgcctttagtaccactgcagaccaactaatcagaactcttttttctttttcttttcttttttttttttttttttgagatggagtttcactcttgttgcccaggctggagtgcaatggcgcgatgttggctcaccgcaacctctgcctcctgggttcaagtgattctcctccctcagcctcccaagtagctgggattacaggcatgtgccaccacgtctggctaattttgtatttttttttagtagagatggggtttctccattttagtcatgctggtctctaactcccgacctcaggtgatccacctgcctcggcctcccaaagggctgggattacaggcatgagacactgcgcccagccaactattcagaactcttggggcaggccttttttcatatatattatatataatatatatgaaatatgtatattaactttttatttaacataatatcaaacttacagaacagttgtaaaattaaatataaaatattgccacttctttcagcattgtactggaggttttagtcatggaaattaggcaagaaaaataaacaaaagacattccgattgaaaaagcaataaaatgatctccattcattcatgacataatttggcatctacaaaaccccaaggaacatacatacatacatacacacacaattagaattaataaataacttcggcaaggttgcacagtatggggtcaacgtataaaagtcgattgtatttctctacactagcaatgagcaaacaaaaaataaaattggaaaaccaatttcatttactgtagcaccaaaaagaatgaaatacttagatttagaaatacacttaacaaaataagtgtaagacttctacattaagaactacaaaacaatgttgaaagaaattaagatctaaatagaaagacatcctatgttcttgggttgaaagatttaatattgttaacatggtaacaatccccacaaggatgtactgattcaatgcagtccctatcagattcccagttaattttttttttttttttgcagaaattgagaagctcattccaaaattcatatgaaaatacaaggaacccagatagtcaaataatcttgaaagttgcagtactcgcatgtcccaatttttcttctattttttccctgctactttttctcagtctctctttctctctacgaatacatgtacatatgcgtgtgtatgtttttatatacacatgcatacatacacatacatacacacacttttttctttttttgaactgggaataaggtaaagaaagacaatgctttttgttttcttaaatactttgggtcacattgcttcaaaactaagatattttatttataactctaatataattactgacatcaggaggttgctattaagatagtactattacctaatctatacatttcttcaagtgttccactaatgtttttacagcaagagaaagtcccagcccatgtgttgcactcagttgtcatggtctcttgggatctttgaatttggacagctttcagcctgctttgcttttataagcttgatgttcccaaggatataggtcagttattttgtacggtgcctctcaatctgggtctgtttcatgtttcctcatgattagattcagattatgtttttgtttttgtttttgagacggagtctcgctctgttgctctgtcaccaggctagagtgcagtggtgtgatttcggctcactgcaacctccgcctcccaggttgaagcgattctcctgtctcagcctcctgagtagctaggactacaggcacatgccaccacatccagctcatttttgtatttttcactgagacggggtttcaccatgttggccaggatggtctcgatctcctgacctcgtgatccacctgccttggcctcccaaaatactgggattgcaggtgtgagccaccccgcctggcctagattcagattatgtatttttgacaagaacaccacagacatgatgttgtggctttctcagtgcatatcaggaagcatgtgatgttgatttgtgatgttaactttggttaaggtggcattggcgaggtttctccactgtaaggttattatttttactttgtaattagtaggctacttctagggagatactttgaggctatgtgaatactctgctactcttcaaattttctactagaattgagcatgcctctgtaatttttaagagctcattgggttgtacgaatgtcaccatgtttgagagccactcacttaaactaaagagccaacactggccgggcgtggtggctcacgcctgtaatctcagcactttgagaggccgaggtgggcagatcacaaggtcaggagattgagaccatcctggctaacaaggtgaaaccccgtctctactaaaaatagaaaaattagccgggcgtggcggcgggtgcctgtagtcccagctactcaggaagctgaggcagaagaatggcatgaacccgggaggtggagcttgcagtgagccgagaccgcaccactgcactccagcctgggcgacaaagctggactccgtctcaaaaacaaacaaacaaaaaaaagagccgacatctggcctcctggaagaagagatgtttaaactgaggccaaaaggatgagtaggaatagccctagtcactggaaattggtgggtatggcactgggagtagatgttctaggatcataatagtcccagagacatgcaaacatacaagatacctagaaataagccgggtctagctggccagcagagagtacgatataggatgcagacagcaggtgcaagcagggggcattcagtgagtttggacttattacaaaggcaaggaaacactatgaaatgggttcaaccaaggaaatgatataacaatttttgtgctgaaaaaactattccctgactgccatgtggggcctcaatttgagggtggcaagagtgaaggcaggaagtgcagtgaggaggtgagaaggtgataagtgcctggagagaggaaatgacaaccgactacggcagtgaagatggggatcggcagatatacagcagcactgagacacagaagcactgtgtggagagggtgagtgtgaccactgggagatggcagaacatgacgacaaaggagaaagggcttctacaatggatgtgtgagatcagataaggcttcctggaggaggtggtgtgtgccaagccctaatggatgagtaaaacgtagccagataaagtggcaggtgttgcctgtgttctaggcagaaggacaagaggtatgaggacctaaaagcactcaagaaggctgaaacctccagaatggagcacgtggatgtgactggagagagaagcagggctgagtcctcaagggctatgagtgtcacactgagaagtgtgggctttatcctcatagcaacagcaagcggagcaatggaagggtctaaagcaagtttgcggtttagatgaatccactccagtggctcgtggaggatgacctgaaaggcaggggttagggaggcaggaagaacatctaaggagcctgtttgctaaaggtatagaagaaatagctgccgggggtccacacatgcagacgctcaacactggaagttgtcaccataactcccagctcagaaaggacagccaggcagatccattgcaagctttaattggggtcttttctgtaaaccttcggagagcaggtcaaaagatgaagaaaacaccttcccatgcagaagacagaaaggaaaacaacctgttggctggggatggggagaagagagaaaaagcaagggtctcgctccagtgcagaatgaagacaaatgggcagcgagttccggagaatacatcctttctccagaacacttgcctctccatcagggccacgcaaagccctgtcagtcgcgagcagagcttttgtgtgcgtgccggctgcgctcccgttgccatggcgatggggccataagtcatgtctgctggtgctgcacagagccgctgtgatttatgcctgtctcgctgggattgtaaacttttttttaatgttcaaaatccgtcacagccagggagggcagggtgtctctggctcactttggaggagaggaggtgttgtcagaccttgcctgactctctgccagtgatgctcctccgagccctgcagctggggtcgctggaccatctaagccaggctctgcagaactcccttctgactccagccaaagggtttcaaaaacctgaggttgatgctcattcctgaggccaggctactacctcaggagtatcctgtattcaattctttgttttgcctccccaggcttagactatgcatgccagctttttatgctttaatttggcttaataacctgcactatatcccagcctctttacaactggatttctagaaggtgcaatggaaagaatgtgggtttgaaatcataccttctaggcctgatttttttttttttcatccattcaataggactaatataccttcatctaaggcatgtcttctcaactttagccttttgctattgggggttggatagttctttattttagccctgggcattgtagggtgtttagcaatatccctgacttctatctactagataccaatagcaccctcccagttgtaaccccccagaaatgtttccagcgattgccaaatgtcttctgggggacaaaatccccctctttaaaatccagtttagagatgaaggaagtgaagattttcctcctgacctatactattctcagcttacacaggaaaccaaaatttcctcccaaagaccaggctgatcattccttctagatgccatgtttacctgactggaccagacacctgcacagctgactcagcccccagaacctgtgaagtccagtgtgtgaatccagccagatccatgtcatgaatctccccaggctgccccatttcaatacagttaactcagtccggtcacacctaggaggagactgcagggctgaaagatgctgtaagaggaggagagaagaggtgtattgtggagccatactgtctgttccagggactctgcaactagagtgcctttaaggtgtgtggcataatttgctagaactggcagggatggccatgcacccttcccccaaaaccattcttttttctcttatttcttccccccacccagccccccaccattttttattttggtaaaatacacacaacataaaatttactatcttaatcacttttaagagtataatttagtggtattagtgtattcatattggtgtgccatcatcaccaccatctatctccagaagtcttctcatcttgcaaaatgaaattctatacccatcaaacaataactctccattctcccctcccccaactctccgcaaccactattctactttctgtttctatgattttggctactctaagtacctcatataagtggaatcatacagtgtttgtccttttgtgcctggcttatttcccttagcatagtgtcctcaagattcatctatgttgtagcatatgtcagaatgtccttcctttttagggctgaataatattccattagataaactgttgacagatagttgagttgcttccatgtttagctattgtgaaaaacactgctatcagtctcatattctttttggaagcatctttgagtctcactccaatgactcaatcatcatgtacttaatgaacacttattggaggcaaaaccttaggaagggcaagtagagtatgcagaaaacaagagtcacaataatttctgaaaaggcatgagtttaaaaatatcctaatgaaggattcctacaccagatcaaaatctgggctaaataattgtaatataatgacaacaacggtagccaatctatttacgctaaatgcatcatgcatcaattcacttgattctcaacagcatttgcacaaggtagctacagttatttctacattgcaaatatggagaatgaggcagtgggatatgttaacttgtccactgttacccgcatagtgaatggcagagctaggatttgaggcagagcatttagcaccatagcctgtaccactgatgggatgcattaggctaaagggtttcaactggcagggttgcttcttcttcactactctgtctcacttacttttcttcctctgttgattctaggaaatgttatagttctactcacctgggacttgttctctttctggaatatcccagcatgggcatcctatccacacactgcctccccagtgaggaccctatgtcttctgcagagtcagggaaattaaacagggagctcagaggttggccagcttgactaagccaacaggagagagaccagttccctctgcccactcccaaaatatgtgtgtgtgcttcaaaagatgccccataggaaccaaatccctcattttctgatgtttggtttaacttgtgtagcctctaagccatgatggactcatctggtattacttgatgtcttcaggaatgctggtcttgaacttgctcctacttgagtagtgttggagagattgtagtatatagacttcatttcttaaagatttatgacatttgttcacatattaacatccctgggaaaactgccagcaaggaaatcaatgtagcaacttcatttataatagggtttctcaaaccttttaaattatggaatcctcctttttaatttcgttgcatctactaaccccaaagtactagtgttatttggaaccgcgagataatgtgtgttgtcataatataatacaataggcactgggatgcaagaaattttgataggactgttttgatggtagagtgtttataggtaaggggattgaatgatactttgagatagcgtaaaggtgtttgttaagcaatttagtagtaatatcaaaacatcttcgtgaacatacaagcagagccacataaaattaatgtcattgcaattttctatatcctctctctgagctatttactgtgcttagaactgggaatacaatgatgttaagattcgatccatgaactccaggaacacatagactaccaggtgagggcagaaagggatactaaactacaattgactccaatgcaatataaggcaatgccctgacccttacatctggaaaaaatatttttgcagcatgaacatagcaatgaggtgcctatgattctggagggcacattctcaaaaggatgctcagaggaagtgatgcttctgtaaggctgggatggataaggagtagtgtgctaggtacactggggactgtgagttttgggctattttaggcagagggagagcactggcaaaggcaaggaaaatggaaagtgtacagcattttgaggaaatagcaattgaggacatggtgggagatgagatcagagggtattatggccagattgtgaagtgctactgaatgctggctgaaacagtatgaatttttattttgaggcagttgaaggatggggagggctctaaatggttttaagcaggaaacagccatggcccaattggtacagcggttggattggggatgtgcacagagtgtggtggggactgaaagcagtgagactacgtatgagggcctgagccagaaagtgtccacgacgatagagaggcatgaccatttttgaggatattttgaaggtaggatgaaagaacttggggctttcctccatttgctcctccaagctcactctcagcttattcttctcttcccttgtgctcaggaggctgactttgatggatggactcgatgggcttttgtagttggcttctcactgggttcagccaatggcagcaccagcaggaggtttggtgagaagtggttgggtgcagttgggacatttattttcctggctcttttgcggcagagtcaccatgaactgtgtgtatcccttgactaaaggcctcagctccatggaattccctctccatgtttttgtaacttcaccctcaccttgacccagacactagccacagggcactgcagatctcttgttgcttttctggaactttccctcaattttgtgcatagtccccttttaaatctccccaagcttgagcatgccacctgtttcttgctgggatcctctttgatattagtcttcttgtttggtgagaggcaaaggagttgaacctaaggtacagatcaattaattattcattgacatatccaactcatctttctgactagactgccctggggtgtgtgtgtgtgtgtgtgtgtgtgtgtgtgtgtgtgtgtgcgcgcgcgcgcgtgtgtgttgactactgggtggttgatgcctattgggcagagtaagatacgctaagggaaacatggttctactcagctgcaacgagtgggccttaaaaggcagaatgatttctcatcttagcttatcttggtgatcactgtccctgagctgctgtctgcataattgaaagtatggcctgtttaggtgagacagagtgaggctttccaggaaacaacactgtgagaccgtggcaggcaacggagcaggaggcaatgagatgtctatcagcagaaggtagattccatcactcaggactgtccatgcaatggcagaggataaaaaatatgcgtcagaagatcccttctagtctgtgagtttataattgtttaaacaagcctttgaaactataggacacaattcaagggccctatgatgtgggtagtttgttcatagcttttaaatataagtgacaatgatagtgccagaccagagagtatctaggaagtacctacatggaggcctttactctgctacaagccagaaatttatttcaggaaatgtattggtaacaagataagattatccaaatatatcctctgagataacatagatggatggaaacttgtggataagacagttccatttcaaattcatcctcagtatctccattcacatgactgtcctttctctcatgtctcagcaaccaaagttatcgcttcattttgtaggggaacacaatgaggtcatgacataggaaatagggaggacttctaaataccatcaggttcagagatggcaaacacatgacccttctgttacaactcctcctccaacactgaaggtgggcaaatgagttcatcatgatgctttccccagcttagtctgtttgtagtctcagaaaccttcccagcataatatcttaggcagcccctaaccatgtatctgagttggcatgtaggctcggttaatggctgccgtctttgatttagtccaacctgttagatgaataaacttaaacattcagggagaattttgaagacatgggttggaatagatttgcagttcatggtcctctcaattatttccatggctgtatctgtacatggtgaccctgtcccctaatgataagccagggttggactcctaacatgtgacagacttctctaggatttttcgaaaggagactcagggaagagaactatttctccctggtggtaagagtcacaaagagcttggggagtcatgattatcacaacccctatcatgacaagatggggagtacagaaagaaagtggttgtacaatagaagagaatgaagccatcatggaatgatacagagaggaaaaacagaatcctaatattatctaactccctcaactttcctcattcctgtggctgagctgatctctttccctttccatgatgtcattccaatagagttgccattaagctaacttgaattgggcctctgtcccctgaatcccaaaccatcctgattcatacagagcagaaagggcttccatgcaggaagtgagggagaagccatggaatgatgaatgggtagatggatggggtcttgaggtcagaagtctatgttcaaattctaattcatccctttaccatctgtgcttcctaaggccttagaatgtcagcttcctcatctgtgaaatgggagataaaaatagcttcaacttcagaagatggctgtaaagatcacttacaggaagctgagcgggaggcctctgcccaaaatgctgcttatcactatctccagtttggggtcaggcttcaaacccaggtatactaacccccagcccagtatacatgcccaaaatcatactttcatgtgtctctctctttcatctaaagatctgtagacgtgtctcaacatcagaagtccccttttaaaagtgtttaacttctaatgcagatataacaactcatttctcagtttcactgtatctgcaaagctttctataattcaacatcaaatatttattattacatttattaaagttttaataatttagcatttcctgcatgtaagatagaagcttagctaactggttcccctttatccagcctgggtcacttcaatatttatattccaaagtctccatttcagtttcatttagcagaggctgtgtcttgagccctctatctgagctgacagttggtgcatgctacagtctccccagtggcaaagacttacagaaatttggtgctgaacaatgtttgaagagatttactgagcctgggcagaaactcatcctaatagacttcacttttattatgattgctaaggtaaaatggggaaaaatatatatgtctccaggctcactggctgaatgacaggtagtggggctggaaagagtggagggcatagagtacgtccacctgggaggaagtgtggtggccttttatagtaatgtttctcagacgggcctcattttctttaaaaaaaaaaaaaaggagggatgtggaggtaccacgaaaatgctaatgcccatattccatgaacctagctgtgagttacccacactctttccccttccccatttgatatttcaccttccacttgcataaagaacacacacacttaatagaccaaatgctcaacaaagaccaagatataaagtccaatgaacctattcctccatcttacagagaatgccccttcttcaacaacagccaacatttactgagcactcacaaaacatcctgagttgaaatcctgattcggccacatactacccatgtgacattgcatgaatgacttaacatctttgtgcctcagtttcctcatctgtaaataacaataactacatcactgagttgttgtgaggagtcaaaatgaaaacatgtagagcacttaagacattgacaccaagcaagtgtgatcaataaatgttagtcattagtattgatgactatggggctaaaagtttaagtgttatctcattccattctcaaaaaaacattcaaagatagagtgttagttatcattcagataggaaactgaggctcacaaagtttaccttacccaaggtcagctagtcagtggtggagctgggatttgagactaagcagtttggctccagtatccatgctattcacttcgcccaatacctcttctgtgtttcaagcaggtaagtgggttccctattgaagttctgtcaccctttgggaaaggaacatttgtgtgagtaataggtgagaaaaggaaaagtttagaggaagcatgatggacttgagagtctacctgaagaagccacccttctatcaacatccctactgaaaaggaaagcacacttctaggttgcctacaatgtgtgcacacatatgcacacataacacgcatgcactcattaatgaaagcttgtaagagagctgcaagggcaagaagtcagttttgctcacctccaacaggacagagatatcttgaatattaaatgatgtaagaccggtatcaagggccttccccccatactctgctgccgggatccttctcaagccaagtgcccccatgcaattcatcgagtgactggccccgactccagcctactccacgtgtcctgctgccccaaccctcccttctgccatcaatgctcctgccatcaatgcacaatgtgatccagagaaaggaggcacacatcccttctttataccgctctgaaccatgaactacatcttttaatcacggacacactgcatcacatggttgcttccttaactgtactacaattctacaattcctactgcttctaaaacttctcattcattgaatatcagttacatgtaatatgctgtactagtaaccctatacacattatgttatcctaataaccaccgtatgagaaaaacacacaaatctccaacttcctggttctgacattgaggctcgaagaggtgaacaaactttgctcaagttaattctacactctttcctactccttcttctctttctggtttttctacttctagagcctagcacaatgttcattacacagtgaagtacctggtgtgcatttgttgaggattgcacctgaagatgtatggcccatgtttccagaatgcactgtatctgactaggggtactgcctagtcccaagccagattccagtatctggagcagtcacacaggaacatctgttggggaccctggagcagtgaatgaatacactaccctaaagtgctccaagagtcattgctgactctgctagcccaggtggttaacagctgaaaaaagagagaaaagaggagagaaaagagcatgcatgttctctctgctgtccttctctcccttcatcaactgccatgcatcccttggcactacactgcagccaaactgacatggaagttcctcctggctgggtgtggtggctcacaactggaatcccaacactttggaaggccgaggtgggcagatcacttgaggtcaggagttcgaaaccagcctggccaagatggtgaaaccccgtctctactaaaattacaacaattagccaggtgtggtgttgtgtgcctgtaatctcagctactgtggagggtgaggcaggagaatagctcgagcttgggaggtggaggttgcagtgagctgagatggcaccactgcactccagcctggatgacagagtgagactctgtctcaaaaaaaaaaaaaaaaaagttcctccttaggcatgccacactttgccagttcaaggtcctgtgccttgcccatgaataaaacatctctgggtttttcttatccaacatctatttgctacctgtcctgctttttcactggggaactatcctacctgtgatctcaatccaggggttaaggtgctcctcattcaaccctggtttcaagggtaagttggtgacccaggtctgcctacttagaacactttgtctcttgagagattgatgtgggatattggcaaagatcccaaaataggccaaagagaggcaccatagcttagagatgaggaacatgaactcaagagtcagactctcagattccaaacctggttctattacttactggctgtgtgatcttgggcaaggtacataatcctctttgtgcctcagtttcctcatgcattaaatggagctaataatgagtaaagactaaatgaacttatttcagtaaagcacttggaacagtgccacctaaggatgtgtgattattgctgttcctcagtgacaggacttctgcataaaccattgggaaagggggcatctcattactctggcaacacttaattgtggttgtaagcctggagaggtcagtgagagtgtgcctgaaaaagaaaaacagaaaaacagagtgcaccagagaaacacagagatgagggacgaaaagaaacaggaatagtgagtcccaacatttgggagcatataaaccttactatgccaaaagccattggcactctggagttttcaagccctgatatcttttgttttctacttaagactaagtaggtgatccattccttgttttgctacctagtgcatttgtactcaaactttagtgagcattagaatcacctgaggacttcttaaaccagaattctgggcccacctccaaaatacctaatttagtaggtatattattacatagtttctgtggctgctgcaacaaatcaccacaaactggggcagcttcaaacaaccagaaatctgaaatcggtatccctgggccaaaatcaaggtgtcagcaaggtggtcctccctctggagcctctggggaacaatcttttctttgcctctttcagcttctggcggcagctggcattctgtggcttgtgattgcctcactccagtctctaattccatcttcaaattatgtctccactgtgcatgtcaaatctcactgtgcttctttcttataagggtactcattatggtgtttcagacctgtccagataattcagaataatcaacctatgacaagatgcggcataacatctgcaaagaccccttttccaaataacataatatttataggttctaggagttaagatctgatgatacctttggggatcattatcagtctacactagatatgagaatttacatttctaataagtttctaggtcatgcgaatgctactggtccagggaatacactttgaaaaccagtgagctagtgacttcctgctaacacttcaaaatttggcatagaagttttgagtcctttcttttaacctccaggtgggtttgaccacctctgactttgtgtcttttttctgccttgaactttccctctattcttcttcaactgtcaaaaagtatgacattttttgtttgcaattttgactcatttaaagcactgaaatctttgtcttatttttatatctctattacttagtttaaaatatggtaggtgttcagtaaattctcagtacttggaattgaaaggccaaaagaacaaggagacattcctaattctattcagaactaactcaatgtgaaaactatcaccaagtgagccatgccagcttgcactctgatatcccattattctttcagcgttgttcaggaattaacagtatttcaccatttcattttcgttgatttgagatcacagaaaaatgactgaggcgctccaaaagctgagctttgtgggtgattattattccaactataatagctattctcacatttatcttataagaacctgctccaggtgaaattgtgaagaaggcccagtatgcagtaataagtgttgtttgccatgcttctccctccacaagcatcttttattccatctctcaagttggtctcttgtttcatgctccttgctataccatgaaactcctgaaagcagaggtgggctgtatttatctctgtattcctgtggtatatggcatagtatctggtacacaggagggatccagctaagatttttcagaattaaaatatatctgtatgcaattcagctagagatttgctcttccacctttgtagctggcatcgttagtgtctcaaatgctaaaatctcattcccagcagcttcctgctaggataggctggagaatgggagctgtccaggggagagttttattttgcccttcaacccctcacacttgaaagccttacccctcaccttagattgcacaaagtcaaagcttagctacagtttttgaaaaattggcaatgttctctctcttgaaaatatttgcttaattccctcagtcggatacatcttctttcttttccaatcctttccagtcccctagggcactctatgtttaccacacatgtgactcttcattcattctgtaaccatgtccatgtacataaagccacagacctagcatactgaactagaatttatagactcatttaagtcttcctcaaagcccatgacaaagtggttaatatgaatcctcaacactgagcaactatcgattttcagttgcaccataggtcgtctttagcctttcagcgaaaacatgagaaaataatgaaaagataaagagaacaaaagccactatgttacaataatgagcatgataactaatgcttctaaagagttcaccaggtagcaaactcactgctttacatgtaatatgtcacttaatcttcatcactccatatatgatatgagatttttatttccattattctgaaggggaaaccacaactccagaaaaactcctgcagcaagcaagtgatggagttaagatttgcactcagccaatttgcttgaggtccatagcctatgccctcagacaataaactttatgtttaatcaaaatatagaatacatagagaaaagtgtgaagctcagtgaattttcacagagttaaaacactcatgtaaccaccacccataacaataaatcaaacattatcagcatcacataagcccacttgtagttccccatgtcaccaccctttccatcacccagaagtaatctctatcctttcttctaacatcataaattagtttactcattaatgaaactagttttttttgtttttatataaacatatgatattattttgtgtctggtttccaaaattctatatcatatttgttagattcatccaaggtgctatgtatggttactgtgttctttcatattcattattaatggcattccattgtgttattattccataatttatttatctactttttcgctgatgggtatttgtatttttttttctagctttctagcagtacaaatgagtgcttctattcgtatttttgtaagtcctacttgtggcacacatttacatatttctgttatacatatccttatgggtgaaactgatgagctatagaagatatatacctccaactttagtacataacactccacaggtttacatagtggtcatacttatttatattctcactataaaaatatgaaagccacagttgttccatatccttcctaacatttgttatcattagttgttttaaatttagctgccttggtaagtcacagcctgtacatttaactactaagttgttctgcctactgtagtgtgagttctcatacttgtccaagaatttatcacagattagaaatcaaagaatcaacttgcagtgcacgttcaagttttcctttccaatcctactgtaatgcttaccttccgtttccctttgactctgcttttccacgtagtctttcctctaatctctttgttgtgattccagggcagtattattggctatctataattatgatctattatttattaaatttccaacataccatctgactggaacttattaattctctaaatgcccatgatatgcttgcctgggcaatgtcatgtcaaacaaggtttattagtgcagcttggaaaactcaatctacatagtgcagattctctcaaatggtgatgattgcaatcttttatcccctattgcagatcagggattgaaatgtggcttcatctcttactagtgaaggcattacctctatgcctcaggtttgtttatttatttttgaatctgaaaaatgagcatcacctcatggagctgatgtaagaatgtaataatattagtgaagtattcggcacttacttagaaaatgatcgatgatatgaactattattattattattattattaccctctgtgaggaaggcactgttattatccccattttgcagacaaataaatgaaaacgtagagaattaaacttggccaccatgatcacacagttcacacttggtagagatggaattctaaagcagccctatccaactccagagtatgtgttaccatcagccagtctgagagagctgcatcatctgaatcttcattgaaatcatggatgcaatgtcaacaggacagaactatgaggaaagctagtcaagactttcttttcagctgatttcaaacgaggtaactgtgtctttttgagaatagtcttttaaaccagatggtccttgctttatctttaaaatatataatgcagagagaacttagcacatgctttactaaaatctcgtatacttcaattctatcaaaaatgaaaacaatggtaaatatcgatgaatcagtatgtgaatgtgtgtgtgaagctattttagttcctagtaatcactatttcatatcctaagtgccatctctttataaatctattctttttaaaacatcctcttttgggaaatgctaatagcctagaaaagcatgataagttcatccctcccagtgaaagctgacaaggtgagagtaaaaacatcttaaagtaagagagttgggttctaggagctttctgtcaagatgccatagaaatactgatagcattgtgatttagaatgacccaaaggcaactatggagctgttgaaaaacagtcactggtagttagggggtccatgatttaattctagttcatgagccaataagctgtgtacaaatcagttttagaagtaaaactactctattcttggtaacatcagaatttctagaatgcttcccctaatcaaattgggagaaataaatcctccactggaaagctccagaacagtgctaagatcagatctaagaccacagacttaattaaatcaataaacatttaatagatgtccaatatgtactaggagctggggattaaaaagctaaataagttattttccttgaccttgagaagtgcaccataatggggcagaatgatatgtaagcatctaattagtatgaagtagagtaagtctataatgaagttagctacaagctgcaggataatgtaaagtgaaatgtagtctccgtggttttataagttaagaacaaaagatttagcctggacttttttttttttttttttttgagatggagtctcactctgttccccaggctggagtgcagtggctcgatctcagctcactgcaacttccgcctcctgggttgaagagattctccagcctcatcctcccaagtagctgggattataggcgtgcaccatcacatcaggctaatttttgtatttttagtacagaccaagtttcaccatgttggccaggctggtctcgaactcctgacctcaggtgaaccacctgccttggcctcccaaagtgctgggattacaggcgtgagccaccacgcctggtctttagcctggacatttaaaattcataaattagcccaaagcacatcccatggactacaacagaaaacatcccattttctaaatttttgcctttgtgactctccaacatactgttaagtaaagataagatcattaatgatcccatgatgagctagataatgcatcagcctcttttatatttaatataaccaaaaaggaaagcaatagtgttgaaacgtaaggcattgagacacagtgatggaggtcacatctaagagtttaggagcatggcatatttgacagtgttcttcacatcaactaaacagcaagaacactccttaggggttcctgtggttctccaacagggggacttccaaggttttaagaagtacctatgcagagtactggagatgattccctacctgacatctgcagggtcttccgtgacgagcacatcggtcttgcagctggccagggggttgatggacagctccacaggcggaaccacaaagcttttgctgacaggaagccagaggccttggcccaagctgaaagtagacctgcaatgtaagagtttccattggggaactccctgggaagcagagagcaaacagaaaaaaggggcccctgttcccatcccttctagggcaatttcctacttctccatccatatccccagcattatttaaggaacaatgttggccaactttctccagacctggatgatcatttctcaaatctgttaaacatttagctcatgaattgctttgtgttgctaagttccttttcctgatttactagtggactctgtgaggatagggaccattgccgctctgattttccagcagtcctgacatacagcaggagttccataagcgactgctatgtcagcagggacagtctggcacaaaggttaagagcacggactttgaatcagtttgaactaaaatttgattcccagttctgccacttaatttgctgtatgtctttatctacatgttcattgaagttttacacaagattttgtggaggtggtgggaagaggttctatggttacagagtatttttaaaccactggacttaataatcagtaatgtctcctccagttcaagtatctgagtctataagtctagctgccagacaaatgggaattagattcccatagcaacctgcgccatgatggtacattagtgccagggagagttcttttgtactcagtgcagctcagaagtgcacaggctcaatagtctaaggatccatgaccacatcttcctatcagtcctttctccatttcccagaattatgccccaacaagaaagccaactcacctgagaatcttttcaggggcttgctcccctgtcaccagatcatagcccctctcaagtgtcgtgtagggccaaggtctatgggaagaaggagaggggagagaagatgacattagtcagaggcaggtagaattcacatgtggacactgctctagagtagctttacaaacaaccaaactctgcagaaataattattgggcaagactacttatattataaaagaatgtctccaatttacagaaggattcagcactttcataaagtatgcatgtccattcaggagtctgtttaaaaatgttcttcttttctttggcagtccacttaagaaagtgttcattgattactttgtttggacaggtgacttaaatgtcagcctttgttctctagaatattcaccaatcatgtacctttaatactaaaatgtgattccatgggaaagtaggattcacttcccattgggttttgcaggaacactactgttgcagagaaagagtcctctttgtggagatgcttggggcctctggtaacagaacagaggaggtaaaagtgggtcctgcactgtcctggacctgatgccctttgccactcacccttcactctgtccccagtcactgcgcacacacaggtgtctgtgaacagggtcaggggcatagccttcatgacagctgcactctcctgtaagtgaaaagaaaaaagattattgttaagtagagtctccccaaataggcttttctctggtttgcttgttttcctaagacataaagtgagctgcttagttttagaaaaggcacatggaaagagggtaatcttgtccatcaaccactgtggttaacagagtttattcctttgttcattcactcatttattccttcaacaaatcctggccacactcgtacaggtgctcagctcagcactggagatacagaggtcaaagttgcaacccagccgctaaaggagctcacaacttaagacagggaaacaggaagtgatcaggtggctacaaatggaggtcttcttttcaaatattaaaattatgataaaatgcatttactctagaggtataatcagaaaattgaattatctccatctgaatgaataggtcttcaccatccataaatcccaagttaaatgccgctatctccaagaaacctttgatttcccctttcagaaaaacctgtctgtagtctcctggttttattttgtgttgcttttcatttttaaattatttttcctctcctccccttccttctactgccatctcttctcttgtcctcttttctcctctccctctctcttgccattctttttcatttctttcccttccatccattcattcatgaatcaatccatccatccaaccatccattatttttttttctggccatgccttacgcttggttgcatgaatgcttgctagcattacacactgccttaagtatattctctcattggccaagttcatttcaagtggccagcatatgtccaatttcctagcatatcttcagagtccagaatcctagaagtgatttcagaatctctctgtcctactcccagctgttgtcatatctgctctactgtatacttaaggtatagaatttctttttctttttttttttttttttgagactgagagtctcactccatcacccagactggagtgcagtgacgtgatctcggctcactgcaacctccacctcccagcttcaagtgattctcccgtctcagcctcccgagtagctgggattacaggcatgcaccaccatgcccaggtaatttttgtatttttgatagagatggggttttgttatattgaccaggctggtctcaaactcctgaacccaagtgatctgcccacctcagcctcccaaagtgccgggattacacgtgtgagccaccacgcctggcctagaaatattttttgatttaatgagttactgcttttttctccaaggtttatttgtgagatgcttaaagatgctgtaccaaaaacagattctatttaaaaatgtgtttgggtaataccaccccattcctcaaagccagtgtagtgtgattctccatgagggtgatacatacacaattttcaccaacttatttttctttgggagccttgttggtggaatgactcacaggattataattctatggaacacctctagggaaatgctagtaggaaccgccctgactttgcttactgcctagaatagggtcagtgcttaacaatgtgagttgaatgaataattaactatctgttattgctctggtaaatttccaggctaatgatgttggcttgtcttctttctcatcttcttgtaatcacattatctcattatctctctctgtatctctctctgtatgtatctctctctctctctctctctcacgcacacacacacacacacacacacacacagagagataaacctgtcacccttggatcctacagtgattctgatagacaggacccaaaagttttcaaatcatgtccatggaaatgtattacttaacagagatttagggactatgcaaattttatattttaatttttcttaaaagttttattttttaaattgttaaaaatataaaaacaagaataaacactcagatatcacatgccagaatttaggatactgaagaaagtatcagttgccagataaacttattttatgcaggcttcagggaaaaaaaaaatctcctctcatctttgtttcatctaaaaagatactgaggatgagtcaagatgccaacaacctcatgctatttgcaactacatattttgggaatcaggattttctcaactttatacaactaaaacaaaatattgtagtaaatagaatactagggtaacacgggttctacaactatcacccttaattctggattttgaaatgtatgcattcatcaagtaaacttattgttatctctgatgaactgtaagtgttatatatttgaccttatatgaagcattctgagtgtttaaaaacactgtaacttgttttatagatgacactgctgcttaatctttgtattcccagcacccattgacaaatagcctgggcttcatgaacgctgcctgaacaaaaatggtagtaagacagagtatggagtgaagaatgggtcagagatagtattcaaaatattcagaatgaggttgttgaaagatacaaggagagacagaagacatgtccttttcctctcatctgcttacctgaaaaataaggagggcttgctcacaggtaggaatgctctctgtactccttccctgcaacatcatgcctggggtcttccaccaagaggaagtgctgtaagtagtgctacctaatgaactgattgttgccagaggtaagaggaatggaaggaaaaggctaagagccttgaatgtggatgtaaataatttaccaaagcgaggaggggcaggagtcactaaagaagtgttaaaatgcaacagtcccttcatgaaatattcaccactttaaacacgtctaatattaaagattaaaagtcctgggatttgtcctccagactcccaggactgatttatgatctgctacaagccacaggcctcatgattcataatgggagaggtaaaatggttacctctggcaaaggagcaggaagtcaggctggggtggatgaggaggggccaacaaggaggatccctcttgtttatggaaagggcaaaggctgaggtccctatctctcctgcagtgactctgcaggaaataccacagttcacttctttcctctttctctcatttttggaaatattggtgacattgagaaatttattcagaaaaagggtgctgctatgtttttctctcctccttgtgcacttaccaggcaagttttccctgactcagaatggatcattaattactgatgctcattatacaacaaatatatattttgcaattaagaggcattcaccctggagacccccatgaggcttcctggagaacggaaagtaggcagagggaaaagcccccgagtgctagcagcagatggacccggtcccatcctcttgttctctccctagttgtgtggccttagggaagtcgcctttttggtttcagctttcatttacagaatagggatgatagcaatgtccatctcctagagctgatgtaagaagtaattgaaatagtgaagaatgaagctagtggttgaggtgacaattagctgatggtcatactacccagaaactatgcacactacatgggtgcaatatatccatgtaacaaacctgcaaatgtaccccctatataaataaaagttgaattaaaaaaaaaaaagaaaagtgtttccttccctttaattccaagctggccactgggttctggtatatgtttacatttagacaaaactatcacccctaactccttacatattagacatgtagagacacaaattacctccttttggggccttagtttctccttctgtaaaatggaaggttggagtagatcactcatcacttctgagcaccaagactctgctgtttgcattgcctttccaaatccctaacctctgctttctggatactgtttgttttagtttcagctgcaatcattcttagcagcagcctgggtgtctctagcaagatctccatcaatgccataggtattggctttattgactcctgtttcctattttgctggctcagctaaatctccactatttgcaaccaggcatttccttcttgacagatgaaaagcctctgacagccagagctgagggtaattaacctcttccctgggtgactcctttcttcaactctgcttctgcacacccagagcagcaaggccatcaaatgacagctctctagggatgcatgtaaccatgctgactgtgaactcctgtatagggatagggaactccctatccctataactctagtaccttccttgctcaccactgcatctcagcacctcctgcattgcctggtacagagtagggattcagtaaataaatgctaaatagatgaagggatatatttcacaatagtgatgcctatgccaatggaataggacaataattttttacttgcctgttcccccactaagctgggaatttcttgattgcaaaaacattttcttaatcatcctgtattctaataattagtataatgcctgataaagggtaggcaactcaattattgaatgaatgaatgaatgagtgaattcatacatatatcatgattaccatgaatttaggctgagttcatttagaataatgatgactctgctgaggactggaagaaactttctacatccaagataggtatttgccaaggaaacaaagagtgcaaacacaagtgctgatgaaatgtcaaaaatagaattctattttacatcagagcagaaaagacccttaaagatcagctagttcaaactttcccagtttcattattcagaagaggaaactcaagctaagagagtaaaggagtttgtccaaatcactggcctagcctctgggccagccaggatggaaacccagggctcttggccaccacttcagtgtccttttgctgcattggtggtatcaatagttcaatgcatcctgaagtcttttgcatcaatttttctgtacatttttgacattaccaagttttctaaaaatgagagcattgacaaacaggtattatttaaacagtaaaatgaatttgaaatacccttaagtacattaaaaacatacatgtatatgttgttagtaatggagacctaaaaaaaagaatttactctcttcactatattggttctcataagggaattcaattggatggttttctatctggctatttaccagaactgtgttatcagcagtagatgagttgtgttggttttaaaagatttactcttcatgtctcctggctgccatttgttgaggtctttttctatgttatatgcattctcagtccagaaactcttgggtaaaaacaacaaaacaccttgatcatgaacaatctgtgttcatctcctgtgaggctcttccaaacaggacaatgctttcttgccaaccacataaggccagtaggctggtgaaatagttcagagtgtgggtgggccttgaaatcatcatgtactgcattcaaatcctggatctgcctgccacttcaaatttgcaagaacctgataaattgattcttctctccctgagcctgtttcctttacctataatggagctgacaccatatgcctgtgggaaggatcaagtgctgtacttgaaaaatcctcagcacagtctttggcacatttcttcttgctgagaacacaaaacagctgtttgggttcatataattattgttcttgggtaggaaaggcccatccagtatgttgttttagcagaaaggaaaggtgcttagaatgaaagatggtcaaaaatccaagatgtgccctttgcaaaacccaaaagaccacagtttctttatctgtaatttgggattttttttttaaattatcattattatttttttagagacagggtgttgctctgttgcccaagctggagttcagtggtgcaatcatggctcaccgcagccttgagcttttgggctcaagagatcctcttgccccagcctcccaagtagctaggactataggcacgtgccatcattcccagctaatttttaattttttttggtgaaatgagacctaactatgttgcagaggctgagatcttgttcaaattccagcagtttgaatgagataatccccgaagctgttcctgtgtttccagagctacgaagacatgttgcctgtgtccatggcagcccctgctgaaggaggtatgggcacggacaaggcataagccagaggccgctgcctcctccaccccagcagcacagaggagctcatggcttgcccatgagagtgcaaagcctccttcataagccatcctggctgtctgactcccctccccaaaccctgtcattctatgattccattttcacttgcttctaactcagtcatcacttatcatcaccggccagggatgctgcctgctgttcactttcttatttgctcttcttgtcactgtggtttgaaaagacatctctctgggccctcagagcaataaacatggatcccttccccatgttgactccaagtgagccaccttgggactcttcacctctgtagctctgtaactcaactcagggccaggcacgtagtgggaaaagtatgggttgggcataacattatgagagcctgctttgtgctaaaagtggtatgtgacatttgacatgtgtcattgcatgtcacagccatgactagtacaaggaggaaggtactgatgccctccttgtaaaataaggaaactgaagctaacactcgactagtcagttgccctaggtcatagggccaggtctccaaagctcatgcttgcttacaccaccacaaacatcacaacaataaacataaccacaaggacaataacaaggacagctgcctttgacaatgatcatgtgtgagacactgagggtcatttctctgtagtacttaattatgcattcgcttctttgcagtggttaattgtgggaagagtaaattttctttccttccctttgtcttcaggcttggcatatgacttgctttgatcaatgggatgatgagagccaggacttaaataatcaaagttggaaatatatttatgtggataggctttccctcttgtactcctgcctcttgccattagaaaaaacatctacaggctgtggctggtccatgaaggatgagagatgtgtggaatagatctggattcatcctcagcttagagccaagggcagctgagtcctggctagatcagtccacccagatgtgtgacaaaggagaaaaagatgcttacttatagttgtggacaataaaatgtgattgatatgcagcgttattttggcaaaagtttctgatgtactttaaacctagatgtctacatctctataagtaatggtaccagtttctttcctaattggaaacttcagaaaaacttctaatggggccctattttgtactctcagcatctgagtgatatctgaatcccactgattctaccgctttggttttatccagacccatttattcccatctctcttctctgccactggcctggttcaggccctcagcattgtccatgtgctatgaacctattttctgtgtccctacatctgatctgactgttggccagttatcttttcaaagaacagctgcacccatggccctccccaaaaactctcagtggttttcagttgccttcagggtagaagtcacatatcccagtcaaagcctttcattactggcccagccaatttttccaaccttatcaataactctgcctccctgtgacttttatgctccaattttttctgagtctattggtaagagcagggtcacttgagaccaacgttcagaccctttgaagcttctttcagcaggtctgccttggttctacccaggggtcccactcagagatcccactcaagcaaagcctgagccctggagagagacaaagtcaatgaaggagagactaaagtaagagggagaggagaaaagggaaaattaagtggcaaacaattattttgtaaaagaatgagataatttgggcactgttgagtataagtaatgtcatcaggggatacattttacagccctgaatcctctgcaaatcattctacctttctggacctcagccttcccatctgtaaaatgagtgggtagtacttggatctcccacttttccaaatcttgttaaaattccagcccttgattcttcctctaatatattctggtctggtttcttgaaatcagcatctctcttgtaattcaggaagcaggataagtttgggggcttgggggaacagagggttggtaggcaaagaaacatgattcgcgtgaaataacaagaggatataattagaagctttatgaaatgaggaagattctttataagtctactcagccaaatgtattgtgtgacctgaggtagttccctccctctctggggctcagtttctctatctgtacagtgaggaggctggtcttgacatctgagcaacttcacatgggtgtctctgatatccctttcttccttatactgctggtgtgagactttccaaccttgttcttcccaaagcactgagacaaatgtggactccgcattgtagctgccggccccttattgttattcatcagcacgcctctgagagcacaaagtaaaaataatcagaggctgaaaggttctggtggcacaggctggtgatcaggtctgataagagattagattccttaatcaacgctacatgggggctaattattgttggctcagctcatgtggacagtccatacggggtggtcaggctgctgagaggctgccagccaggccccatcagggcccctgctccaggttctcagccagggtaaccctttccactggccctattccctttctttctagcctcttccacctctgagtgcaccacagacatgattatatattattagtgtctaggagaaaagcatgtggcaaagagcttcccgcaaaatcatggctgattaagtatggagtggggtgaagaaatctcactaacagcctggaatggacacagagcatgtatttccaacaatccagaaggatctggcttcagctgatgaacacaggacgcttaacatggatgcacagagctgagcctgccggtgagaggctggcttctcctcaccctcactgcacgccagagccctgcaacctctaagcttctcagatgcaccaggaaggcatggagagcagagggacacagcctggtaaggggaaaggtgtcagcctggcaaccaaggccattggaggctgaatcctctgtggcctgcatcaatcactgcacctctgggcctcatcagaaaacgggcatcttaaacccaatttttaaaattgtcacaaggattgcagacaatatattaaaaacagttactgcatcgccagacgtgtaggcagcacttggtatgttgcagtgtcgttatcgtgattgctgccagcactgctgtccttgctgtgctgttgtccaggctgcccccccccacccccctgcagtcacgtttcctccttgatttggtgtccttgcccctctgggctgcagctgcccttccaggcttcctgctgtgttagttcctccttttctcctcccgaccggattcatctctggtccagatcttactgctgcagaccagctacccttctctggataattcctctatacctggcacaggggagatggaggcagagagatgaatccatcctattttttctaccttcaagcagctggcattagcgtaggaagacttggaggaaaatacatcactgcacaaggtgtgattcaggctagaagaggagtgtgcaggaggtataggagcctgaaagaggattgctgagctctgcccaggatgggggctcaccagtgaaaagggagggtaacaataagagaaaacccagagggataactacctgccaggcagtgtgggaagttctttgtttagattaactcacatgatccttccaacaaaccaaggtgggctctattactaaccccatcttgcagacgagcagacagaggcccagaggggtagtaccctgcttgctgaaggtcacaaagtcaagtgtgccagagccagaactggaatccatccagcaactgtgctgcttcagagatggttctgctgtccccaggctgcactgactccctttccaggagaattaagtgttttacagagagaacaacagggatgaaagcaggccacagtgtgcttggaaaatggtgggcccttttgctttgctggatcagtggggaatactgcaggcacagccagaaggcttaatgtgcactgaggaatcctgccctggttctgcaggtatgaagaagcagtccctggaaactgccacaacccctctgcaaaaatacagttgtgcccccttatctacaagatgagttccaacccacccagtggatgcctgacactgtggatagtactgaaccctactgatgtggtttggctctgtgtcctcaaccaaatctcatattgagttgtaatccccagtgctgggggaaggatccagagggaggtgattggattatggagacagacttcccccttgctgttctcatgatagtgagtaagttcttatgagatctggttgtttaaaagcgtgtagccttaaacaaggataaatggggactaattggtgttggctcagctcatgtgggcaacccatgtggggtggccaggctgctgagaggctgccagccaggtcccatgagggcccctgctccagactctcagccagggcaaccctttccactggcccccttcactctctctctctcctgatctgccatgtgaagattgtgcttgttttcccttcaccttctgccataactgtaagtttcctgaggtctgccagccatgcttcctgtacagcctgtggaactgtgagtcaattaaagctcttttcttcataaattacccagtctcaggtagttctttatagcagtgtgagaacagattaatgaacccatatttactatgttttttcctatatgtacatacccatgataacatttaatttataaattaggcacagcaagagattaagaacaataaataaaaacaaaatagaacaagcataacaatacgctggtatcactactcttgcacttggggccataattaagtaaaataacgattatccaaacacaagcactgtgacaccttgacagatctgataactgagatggctactaagtgatgaccagcaattagcatatacagcgtggatactatggacaagggaatgattcatatcctggtggcatggagcaaaattgtgtgagatttcatcacactactcagaatgcagcccaatttaaaagttataaattgtttacttctggtattttccatttaatattttcagaccgcagttgactgtgggtaacggatactgtagaaaggaaactgtggatgagggggaactactatagccattctcaaatgctgaattcagttgttagggtggtgagagacaaatttaaaagtagagaagacaggcaatggagtcagaatggaattagagatatgcatttgccaatcaatagctcagtgactttgtaaaacttcctgtctccacccaagactcagcttccttatttctaagttaatcatgcccactcttctcattgagcaacatgaaaaatgggctccataagtatcacctgctattgctatgactactattagggagctggtggctttcctgaccatggctcttattccagacctcttggttatcacttagaaaaaggaaaataccaagagatgctcatgaagtttgttaatcatgaccacttttgatccacctttttgccttcaatccacttaaccaccctgtgaagcgggtgctcatgtcctgattttatacaggaggaaactgaagccgcaaagtgttaaatgacttgacctcagttcatatagcaagaaagcaacagggtcaagattggaaccctgacctgcttgactctgaagtcagagcccctcacctcaactgtaccatataaaatgaatgaactcagcacaacccggtgtctcatcaaaatgccctttgtgaccctacttggccatctaccatacttctataggagcttaaaggaatgtagatgagatcttgctatgtggttgtccacttcatgggatcctggagctctcttttcctgcaaattgctgggtggccttactcaagtcatctcatctctctgagtttcatcattttgacctgaaagatggggaacacaactctgttctcccttattcatgagaatgccatgaggataaaatatatgcttaaaccattcagaacacatgatgattaataattcaattccccacctgaacaaaacctgaaacagcaaagtgaaatacacaaaataaattaagccaagagtaattattcattttgcaaaagggttcttcactccacagaagagactcattgacatttttttttccaagcagcagctatctttgggaatttaaaattaaattccatttatacaattatagcaaaaatactaatgattttccagagtgcactttgagtgcaatgggccatacctgtgtgtcctgcccatggcatcagacaaggcagtctagagatccagaaggggtcagagaggagagggacctttgcttttctctagttaggaatttgagaaaaaagaagagaagctggattgtgtgctctttctgaggggttcctttctcagagtgacctcagcctcaattgcaggcagatggtcagggtcacagctagcttccccaggaaacaagaggattgccatttccagtcccttccatctggaatattataccattttacgtaatgtgtacattcagctgaacccagctaattttcactttgctaatctcatttctgattatatttgggttttttttttttttttgatgaagttttgcttttgtcacccagattggaatgcaattgtgcaatctcggctcactgcaacctccacctcctgggttcaagtgattctcctgtctcagcctccctagtagctgggattacaggcacccgccaccaggcccagctaatttttgtaattttagtagagacagggtttcatcatgttggccaggttagtctcaaacacctgacctcaggtgatccgcctgcctcggcctcccaaagtgctgggattacaggcttctgctttatgttttctctcttttgcttcatctctgtctctctttctgtttctcaacgttgtttttgtcacagcctcggtttctctctttggtctctgcttctgttttttctttctcactgtgtgtctatgttctttactatttgtctttctctatgtctccttttcttttagaatgctctgcagtaaaaataacttgagtttagagtcagagaggtccaagtaaaatccccaaatccactttaatttccttatccacaaatataaaaaagtatggtctgccttctttaaggttcaatatgaagatgaaataagacatggcacataaaggtgccaccaaaaaagagtacagtcatttcctgttaaatcaatttcccccttcctttcttcttaaaagttcttttgtttgtttgtttgcttttaagacaaagtctcgctctgtcacccaggctggaatgcagttgcacgatctcagctcctgcaacctctgcctcttgggttcaagcgattctcctgcctccgcctcccgagtagctgggactacaggcatgcaccaccatgctcggctagttttctattttttagtagaaatgaggtctcaccatgctggccaagctggtctctaactcctggcctcaagtgattgatctgcctcctccagcctcccaaagtgtttggataacgtgcataagccaccacacccagcctttcttagagttctttaattttccttctttctcttcccttgtcttcccttccattcactccactgcctttgcaccactctcaaacaaacaagcacactacagcccccactttctggcaatgatttaattgcagaacagtgcaggttcccattaccaaggctctcattcttttacaaaacatttttacagtacatttcctgggatataatggagaatcattgtgagtcattaaaattaagcaacgtgtgtctaagcagcctgcatcaggcttcactacagagtcaggtttcattgttaggttcacttctggccattggagagtgtgatgggctgttcacaccacactgggtaaggtcacctgaacttacctgagttgtgtgggacattttgaattctggatgccctgtccaaaggaagagtcctggtgttagcaacgtaaatccatactccaactgcccatcacatactcccattttctggtagaaactcaaaccatctagtgaaattttaattaagagaccattcaacatcgtagccaaaaggcagggacataacagaccattcatcacggtagccaaaaggtggggacacacacacacacatacacacagaaacacatactcctccttctattcagaggcctttagtcatccacactgaatcaaatgctgccttcagtctagcaaaaggagagaggatagtgtgctgcaatgggcagactccctacaggcagtatcaaataaccagaaaaggcaagtgctactgctaagtgctgcatttcaaatggtttcctagaggtcccttctgcacagaaatctgtcatcatgccttccatttcatcatgattaagtcttttgtgtgttaagtattgccagcattggggggttctttttgtccctgattcaataattcccatatgttgaacacatatcttttccatataatgtagcagatacttcgtaccgataataatcgtcacaataacttaccaaaggtgaatacttctccctcttattaaaaaaaaaaaaaaaagcagaaaattgaggcttggagaaattaagtgaattgctcaaaattataccaatagtcaggggcagagtcaggggcagagcccctgctcagcctccaccagtggttcccccttgcattcaggacaagatttcagccctggtctgtctgatttcagtcctaggctctttccatgttgccctgactgcctctctaaaaaacaaaacagagcccagcattcatgcagcttgatcatgagctcttggaaggggccagtggtgtctcttttgcttctctccctggtgactgactcaatcttcaggctcagtcaatgtctatgaaacaaagacattaatgaagcttatgaggaacacacatgccccagatcctctgcactgaaacacttatttatatgaatgagcgtacctgagcacatcccttcaagacaagcccagaaaagcaatgccagaaaccagcaccaccttcacatgtggcaagaggccatgcaaaatgtaatggctcaagtttggagctgggaggatgggggcttacatcccaaggataaaatattttgactgcttaatatgttctcaagaggaagaaaattaagcaccattatggtagtgttgcagcctcctctctgccactaagttactgaattactaaatgaaccctcccaaaacctcaagctaatcaggtgtagaaggaagccttgggccagataatctgtagggctcctcccacccctggagccttttgttatatgcctccacagtgcccaatcctacttgttatctcagcagagtctttaaaggcttctcaggagaaggggtagaggcaagggtcattaattaatatttttccctccacatttaagagggcatgtagaattgtgtaaggacagggttatcacctaaaaatgagtgcctccttgaagtttttgcctgaggtgcctcattcagttcattctggtcccagccctgcttgacaaaaggatcagcaaagctctattcaccctctcacttgtatcacatacctgcttcagtgtttctcttctcctttcaccctgagttggtgttgtcatctcctaggtcctatctttagagatggtataaaaactgggtcttgggctcaaacacatgggggacacacaacgagcaggttcctcaactctgatgtcaaagcatgaaatcagttcaccagaacctccctggggcatagacagcagcttcttttgctaactacctccaatactgagcacaatgcctggcacataagtgatgcacactaaataatagcaatgaatgaaatgcaatatctggattctgaatgcttctttctgccttggcttttcccaccctgatccaagccaccaccatctctggcatcacatcagtcttccccatcagtctcccttccaacatgtttacctctgttcctacagatgtttcctcaatagagatgccagagtgatactcttaaaatagaagttagatgacgtcacccctctgctcagacttctccagtggttccccattgcattcagggcaaatgaaaatgctaatgtttttacaatgttctgcaaggccaacccaggggttctggccctctgaacgctctgggatcccatctcctaatatccttctagtacccagttcaacccagcacattagcctctatgatcttcctcaaatatgcaaggcacaatcacccctgtgagcctttgcacagcctgttccctttacctacactatgctttccccagatatccacaaggcatgctttgctcccacaccttttcggttgtgcctgtcttgaacagtctgctcaaatttgcaaccatttctgcaacatgtacagccccctctttctacaggcttcacacacacacacacacacacccctcatcttctaacatgtgatacactttatcacgttattcactataattttattactatatatagtatatacagcaatacaatttcattactatagatactatatataggaataaagtacataagttactatatacagtatctatatatagtaataaaatatataaattactatatttcatatatagtaacgaaatatatttagtaaatagcatgataaagtgtatcatatattatatatagtacattatatatttctacatattcatatactctatatatgtatatacagtatatatatagcactttatatatgtatgtatgtactatatataacatactatatatagtatactttatatagtatgtacatgatatatatatatatatatatatattttaactatattactatatatattttagctctgtgcctgtcccctgccccgcaagaatgtaagttacatggtggcagggatttttttgttttgttttgttttctttcttctgtcagagcctcacatcctggttaaattgggtgcttgataaatatatactgaacgttcagtgaacaaatacatgaatgaatgaataaataccaaagccatttttttcaacttggacatcaaaacattaaatgaattcaatagaccaggaattggcaaaatttttctgtaaagagccaaatgacaaatatgttcaggtttacaagccatagggttgtgactgctcaattctgatgttgtagcacaaaagctgtcatgggcaatatgtaagctaatgagcatggctgtgtttaaataaaaactaatttacaaaaaaacagcagttggcctataggctatagtttgctgactcctgcactggactaaacactattaggtaaggcagtggatctgaattttcttcctgttgaatatcagtacataaacacagcacagtgtctaacacagcattgccactcaataaatattttgaatgaaatgaaatatatatgaaatatagttctgctctttactctgtcacagcactgtctaattgagcttgttgcaacaatggaaatgctctatatctctccaatatgaaagccaccagccagatgtgactgctgaatatttcaaatatggtgaatgtgactgaggagctaaatttaacattttatttcattttaattaatttacattttaatttaaatggccaataatggctaacagctactggattggacagtggagttctatcacaataattctcttgcttcatgattcagttctattatcttccacccccaccagaggaagccttccctgattgctaaggctcacaataacttttttaggatatattcatttcactcaatccatgttttagtcacagctataataataccaaatgtttgttgagctttaagtaccaagtattgtgctcagtgcataatacactttatctagctcagtcctcataattaccctccaaggattgccatgttgatattcttaccactattttacctctgagaaaaacagaagtgtaggaagggtcagcaaagtgtccaaacttgtgcaggacccaagtgggctgggatttgaatcttcatccatttgaatccagagtgcaagctcttgaccaccacaagatgcttattaagtgtaaacacttgtgttagtacaagtttcatgtgttcacatgttatctatccttcaagagatcaggaatcagtggtcttcttcattctacatatttcaaagccagaacactggctttcaataaagattttcagtatacagaacttcagagctggagagtactcagggaaaatctaatggaaatgctctttgtattataaataaagaatatgaggcccatagagaaaaggggacttgtcaaaggtcatactatgggtaaattacaaagctgggattagaggccatggagtttttctctgaattcaatatttcatctttcatgtactaattccaccattcatttttaaacatcaacagtgtgttagacaatgggttgggtatgaggaaaaagcagtggataatgcagacacaatctttgcctttataaggcacacagttttttagatagctagcaattgaacaaagaatgacacaaataaatgtatcattcaaggttgtaattatgtgctgatagcataggcttgtggtttagagggtaaattctgaggccagacttctaggtttcaaatctagacaccatcacttcctaaatgactttggaaaaaatccattaactgtgatttagtttcctcacttgtaaaatgagacgataacactatttcattacattaattctaaggcatgcaacttctgacattttatttttatttccatttttatttatttatttttagatatagagtctcactctgtaacccaggttggattgcagtggtgtgatcatagctcactgacactttgaactcctaggctcaagcactctgctcacctcagcctccaagtggctaggactacaggtgcatgccaccatgcccagctaattttctcagatttttttagagacagcgtctcactatgtttcccaagctggtcttgaactccttgtgatcctcccaccttgaactcaagttcacttgatctcaagttcacttgaactcaagtgatcctcccaccttggcctcccaaagtgctggattacaagtgtgagccaccacacccagcccccatattttaatattcctaaattgaggacttatctgataattattagtatagtatggtatagtatgattattattattggcagtattttttcttagtggtacataaactatatacatatgtgtatgtgtcttaatttatttaaaatataatcacatctacctcatataattattgagagattaaatgagataatatatgtgaaggctttgaagagtggctgacagttatcactgtataaatgtgcaccattattactatttactataaaggaaaaatagcaccaatggagcataatgcattggggaaataaactagtacagaaagtcacttccttgaggaagtgacattttaagttgaaacaagaaagataaggaggagtgaaccaactaaagaatacagtttataagaagtggggctggatgaggaacagattgtcccatgcagaagaaacagcaccatcactaactctattacattggctagaagaaatgactccccattaacaaatatggaactctttacaacatggctttatatcctaataacactctcaattccaacctaggcttcattattatctttttttccatacatttgtttattgataatatatttattgtaaggttttgcatatatatttagaaccttcctggatttattttttaaatagtaggacatatgccatttttagaagaccaatatattttttaacacattttttagataaaattaaatatagtctctaatttaaatgtcagtagattatatttatgatgttaaaatctggtcttaaaagctgagcacttcccctttttggtacctataatcatcagaaatacctgaggctaccttcttcctatatgcagctttgtggtgtgagatttcagatctctgacaaccttttttctttcaagttcagaagcaaaggttgccttggactttcaatgggactggcaagttcccaataagaaaaagttttcatagtctcttttgtagtttaccctaaccttcttgaccttctaaatttttgaacagtcaggcctggtgcttgctttgcaggctccctgaaattttatgacctcatcctagacacagattgtcctttcttaaaagaccttaaacatcttctacaacataacattttacaacacatttaaaccaaatatatcaagactaccaaacagagataaaaagtagtttccctacaacccatacatgctgtcacagttccttctacctctcagttctgtattgtttccctgccctcaattcaattcagtatttttgtttttttcaagtcaacttattcagtaaattctttgtccaaaggattcatgcctgcctctgagaattctatacaaatacctatcaaagggggaatcccagaatgcctctcttttctcaatgctaagcaaatttcctcacatgctaactccttaaaacagtagcttggccaaatcccagcagtaatacttagtaaatatatgaacttgagaatgtcaatcaactactttaagacatagctacttgtattgaagcaaaaataactacctagaagtgttattataataactgagaatagctatataaagtctttgcatggtgtttggtacacaataagtgcctaataattttagatgttgttattgtcacttcaatgttcatgtacttcttgatatctcaccaaaattccattgtacctcttttaactattggctgtatttggctgttgtctaacactccatctgctatatatagataatgaatctgcattgaatggattaatctgatgagagaaatgggatttatgagttactgacttgtttcatggaatgtaagcagaaaactttggtttcttgtcatttcaattacttttgttggaaaatattttaaaaagcttaattccattatctttcatgcctgaataacaaagtatcatgttcgttaatcgataataagttcagatgacttctgtttaattcaggttctagtaaaattcatgacaaatgagtggtgaggtggagagcaatatgggttctgaggatcagagggactcgtttcatggaggatatccccagttgaggctctctggactcatttgtatatgactaattctgaacatataaaggacagaatttaccttatttgagttcagaaaagaccagtgctgcccaagtcaggggaaaaggtgagtttcagaaaaggattaggtatctctgagcaagtctttatttagcaaacacacactttagccagagtgttgtcagcaccctgagaactctccatggtgctgacacaagaagcctacaccttactcattgaacaagccttgacactttagcagctgaaatttgattttcatccatccatccatccatccatacatccatccatacatccatgcatccatgcatccaagaaaagatgtattgatacaggaactgtttcatttccagatacagcaataaacaaggtgagcaaagaccaagacttttataatgtatatacccatatacaaatgtcccctctacagtctgccagaaagttggttctctataaacaaatatcagcatatcttactgtggattttacctacttattgccatacttcaatatatatgctctaccacatagaaagccctaaagataccacttccttcaaaacagggaatttctccatcactgtagattcttggaatttatagcttcataaaaatcctgtatccctttaaactttagtaacacagagctcagcaaatactagaaacaatctgtaaacattagaaatatttagtacaatataagattgctatatgacataaccacatacagtgtattctcatttcatatcctactacaaatgaaaagtggctgctgaagacatggaaataaactgaatgtaatggtgaacatgactgaagttcatatcaattgtggaaagaaaattcaatttgctataaatgccatttacaaattgtttcaatcatacttacatgctaagttattagtgcttaaaaggtcatagaaacatggattttgagcggagaatatcctagaaattatttagacttttaatttgtatcttgccactaatttacggtgtgacacagggcaatgtgcttagccttggtgggtcttggtctcctcatttgattacactagatgatggctaggaactcttcttgcactaaaagtatgtccccactcattgctttgttgaagagaaggaatctgaagttcacggtatgtaacatactcaaggtcgactggcaaatttgtggcaaagttgacatgagggttgaagattgaaggttagtaattattttctttctttcctctttctttctttctctctttcttttttttttttttttttttttttttttttggacagagtctcactctgtcacccaggctggagtgcactggtgaaatctcagctcactgcaaccttcgcctctcaggctcaagcaaatcttgtgcctcaacctcccaagtagctgagattatgggcatgtaccaccacgctcagctaatttttgtatttttagtagagacagagtttcacagtgtgggccaggctggtctcgaactcctggcctcaagtgatccacctgccttagcgtcccaaagttctgggattacaggaacgagccaccatgcctggccagtaatttttttcattgcaaaagttcagaagtcacacaaggactaaataaaagttcagcagatagaaatgtctagcttactctaaattcctccttcagctggttagctactagctggttagcagagatgatatcatattttcttctcacataatctaatgttatgcacattgttggattaaacgtctcatgaaatatttattgaattaataagtgaagatacacatgactgaataaatgattatagaaataagagaaaaccttgtattgggtttccaccatatattatccactgcaccagtgcattttaaattttatttttcatctcatccttatgacaactctaaaaagttgaaattattcttctcatttttagttataaaaaataaggcttgaatatgttaaatgacttaccaagctccctacaaccaggaaacagagaagagagaatttaaacctggctgtgtctgactcaggaagatatcccaattctactgtggttcactacatgcttgaatgaatgaataaacatatgaaagaatgagttagtgttccgctgtcatttgctttatgtgttgtagaccatattgtcaaaggttttatttacagaacttggtgtgatgccacagatgtgcagaactttaataaagctgtttcgcaataagacattacccacattgatattcttgagagtcaaagcctaatgatttaaactgtgtggtgttgcattttactggaccagagcaagtagtccttggatgttcactttctgtcctcagagagatgaagataatggtagtctgtcctgggaaggagcataatgtcactctggtgacatgttcaagcctccactagccacttttttgccttggtctttcattggtttgttctcatctcatccagtgttgtgctggtaaatgtttaatgattgtctttctgaaaaaaataaactctgattttgttgcatttaccaattgtgttggtgtaaacatcctcaccatagcatattttcaggctatcaacatgccatcactgaacaaagagttgggaaaagatgttaacagtcaactctcatgatgccatgtgagctggctccagcacatcacagatctaattccagagtcatccctgtgggtggcactaattgttgaaatccctggaaaaacacactggaaatgggctgtggcatgcagccaggaaaacttggccaggttcatctgtgcaccaagacaattatatatatgtttcagctgtagcatcttctccactttccttctccttccctgtcacttgggagaaaaaatttttcttatcaacacatccagaaaagctttaaggaatgataaccagtgctttgactccatgactctgtccagctctacagatttgactcacaaaggagagacttctttaaaagaagctaagccacttttgacatatcaagacctaaatatacatagggcttcagggtttagtttttccatgactttccccaaattctaattcctgatgggaagcaaagagtggagaaagttctagctgttcttttagggagttagatgctctccaaaacaggtggactcatctgcttgtgagaacagatgttctcaaagtctttggatccttaccttttaatgacctctcttcatattaccttcccaacctcatcccctgccactctcccagtgctctgcctgcacctcattctccagagggtgcagtacaactaaactgacctctgagtcctagaatcattataaacttttctgtttttcaaaaaatcaagttccctctgctaaagcaccctccatactcatagtccctattgattttacaaagctgagctgaaaggtcatcttcttcatgatgtatctcctgaaatccccatctagaatacatttctccctgttcttcaggcatggggcactttgttaatgcattgctcttgatttatactacactgtgtttttgataatagctatatatgagcagattatttttatacctgtgagaatgtaaaatccatgaaggtaagaatattgtgcaatttgtctgtgatttcccataacactcaacacaccgacttatgagttgcagaattaagaaaatcttgcttgaattgaatctaatgaattgaactaaattttacaaagtggatctgagttaagccccatgaaaatatatttagggatcttatgttcctatttcaattttctacctgtagacagtcctatccatttatgccttgagtgacttagagcaaggtgctttgctgggcattgcggtggaaagaatataggaataaatatgatctctggccctaaggagttgactttctagcaggggagataaactttcaaacagtaactcaagttttaatctggtttttagtcaacaaagaactctgatgattctgtagaagaagtaatccattctactgagaagaagtaagaagaaattaaatgagtaggattgtggaaggtagatgattaaagggtggaagacatttcaggtggagagacgagttgaactctagtcagaaggtgaaactacatgggaatgtttggggaataattgtgagtatgagcagagtaagcaatggaaagagggatgatgttggagatgtgttggaataagagagtaagaccagggtatcctagaattcagatacatggatgctgcacagttgttggcgacccagtttttctagatctgcaaaatatttaacttgagttcttatgtaaatggataaaaggggaaaaactagaattggtatatacaattgtttcaagaagcatcaggaggaaaattccgttcttccttcctgcttgtattattctttgtctcttaattacatgtcaggcattatgctgaattttaaagatagcaagaaaagtgaaacagacatcttgaacctcccgccttgctccagcaaagtttacagtctggtgatagttccagacaaggaaagaacaatgactccatagaggaacaaagccatgacatatggaagcacagaaggctatgacagtaggtgggagggccccttcatctgttcagggctagagagaggggttcaggaatgccacctgtaggaggaaaagtgtttgggctgaacgtgtaggaaataaaaagaagcccttgctctcccattaaaaggaaaaagacatttttctttttctgtgaaagggacagaggcatgcgagggcatggtgccttcaggaaactgcacatgggtagtgtacctagaacccaggacacaaggcaaatacaggcagaagatgaggtgaaagaaacagacacagttttgtcaagataattaaactaacaaatttggcaactgagtcatcccctgtgagtgcagaacacgggtggactatttgggagtgttcagagccttgctgcaacagggtagtccttgagccagaagcatcagcaacagctcccagcttgttagaaatgcagaacctcaggcttaactccagacctgctgaggtttcagaagcactggttgaaggcatggaaacctggctttatatcctggctttgcagtttgccagctgtgtgatcttcgtcctgtcccctgtcttctctgggcggcagtagaatcagccatgaagttgaggaggtggacctagtggattccagtgatatttccagctctaaagagtggtgtgtgtgtgtgtgtgtgtgtgtatttaaatctagaggctattggtggaagagtgccttatttttcaaactggctaacacacaccttggatgacccgctgtttagaattatgccctcaagcctgtgtctaatggagaacagcattagaaaccacaaacttgcacctgaaagcagatcagctggggagctagaaggtcagacccacaggcactcaccacttgtctactgggcttcacagatggaggcaaagaaggggaccccttctgttccttccaccaataatcttgcttccttttcaaggaaaaataatggaaaaaaaaatctaaggggccagatgcagagatatataatcccacaagggcttacctggcttttgggtaagaatatcctagaatttgtgtttctttcacgcgcgcgcgcgcgtgtgtgtgtgtgtgtgtgtgtgttttgcgtgttggggtactggttagggtggcagtgacttaaagcttaaatatcttgattaaaaaaaagaagcttggctgtctggtcatatgatgcataagagctgtgttacattttcacatagcttctccagttgggctatttatttattgattgatttttgggacaaggtctcactctgttgctcaggctacagtgcagtagcatgatcatggctaactgtagcctcgacttccaggactcaagcaaccctcccacctcagcttctagagtagctgggactatgggcatgtgtcaccatgcctggctaattttcgtatttttttgtagaaacaagatttcactatgttgcccaggctggtcttggactcctgggctcaagcgatccacttgcttcagcctctcagtgctgggattacaggtgtgaggcatcgcacctggcccagttggcctatatagaggctacaaaaaatatgctgaaacaggctcctgactaaacaattagagggaatggcggttataaagccaaatcatggccctacctggcagagacacaaaagttaacctggagaagtcgtctccttacttctgaacaggtgtcccattgagaggtgaagaaatcctcaaatagagggaggagatccttgacctggactactacactgagcactgagacctctgacctctgcacagaggctgttgtcatggtattcacgtaaccagtttttcgtgcaagccagccagactcttgtgaatggagagaaagatgaagttccagagaaaacagaccaataacaattatagggggaagcagaagactgaaagtaaggaaacctgaggttctaatcctggcttcacttgtaacttgctttgaaaccttggtaagttcctttttctttctggctcctgttctctatttgaggacaataagaacatcatttattgagtatcaactatgaataagatactacccatttaatgagcatttagtataaataagatagtgtctcatgggtttaaatgtcatctagatgctgtagactagcaaatttctatccccagctaagacttcttctttgaatttgagttgtggacctgtagtcgattttttttttttttttttttttttgagacacagtcttgctctgtcaccaggctggagtgcagtggcatgatctcagttcactataaccttcacctcctgggttcaaacaattcccttgcctcaacctctgagtagctaggactacaagcatgtgccaccaagcccagctatttttttttttttgtattttagtagacagggtttcaccatgttggccaggatggtcttgatctcctgacctagtgatccacctgtcttggcctcccaaagtgctgggattacaggcgagagttcttataattttatgttgtcttggcacccatttaaaatacaagtttaattttttccatcagaagtagggctcagtcatccttgacaaaatttatagttgtacacttccttccagttcctcaatgtggtcaatccaggtacgtgcctgcaatggaaatgacacagcaaaggtggctgcctggacaacagaagcagaccaccacaccaaaatggcccaagccagtggccagagataagaacttagaggcatctttcccacctagcagatgggcttcctgctttcttgtcacttcctttacaggtatcattcagacatttgctcatgaacttaaagtgacccatatcctattccccagtacatacttctctctctctctctctctctctgtctctctctctgcctgattcttcactcctgtcttgcttcctgtgacccagggacagaagattgccttcctgactcaggatctgtaagtaattaatccttgaacttgtttcccattgtggtgtttaattgaatctgtgccttctgtttgaagaagcaggggctatcctaggccctggatgttggggagaacacaagtgcaggctcccagcaccagactgatggtcaggcaggcattaactgcacacaggttagaaaaaccaccaagggtggcagccagtgtaatcaaacttcctgtgtgagggactcctgggtcaccatcagacaaccagatcttagggtgcccaccaggtaaaagaagtatcccatgaagggcacactgtaaacacccacacccagccccactttatttcccattttggcagggttgctagaggttctactactggaaccccaatttagcagggggctcttagatcaggacccaaatgcccattctccattgatgtttagtagtcatcttgaacttacacccaaaacaacactctttatcttcctcacccaaccctgaccttcccactgcatcccctgactcagtaaatagtaactcaatgtgtcccattgttcagactgaaaaatttgggataatctttgactccactctatttcttgcattctattctcagtaataaattctgttgagggtatactcttaaatgtatccagaatctgatcactgttcaccatcttcttctcttacctccatggtccaagccactaccaactcttgcctagattagagtaatagggcctttgaacacccctgaatcaacttaccacacagcagccagaatggtcctattcaaatgcaggtcatagcatgttgcttctttactgagaatctcccaaggactgtccatcttcctcagagtagaatctgaagtccatattatagtatacaaggccctgaggaccaccatgcccccaaacttcttcttctcagctttcttctcctactccccctctttctcactccccatcctggccccactactagtgctaaataaacagcacattaggctgggcgtgatggctcacacgtgtaatcccagcactttgggaggccgaggtgggcggatcatgaagtcaggagttcaagactagcctgaccaacatggtgaaaccccccatctctactaaaaatacaaaaattagcgacgtgtggtgatgcgtgcctgtaatccccgctactcaggaggctgaggcaggagaatcacttgaacctgggaggcggaggttgcagtgagtcgagatcacgccactgactcttttacctccttctgcctggaacacgtccctcggatattgacatggtttattctcccatcttgaggtgtgtgctcaaatgtcatcttctcagagaggcctcccctgaccactttctgtataatgaaactccacccaaactcccagcttagcactccacatgctttgtacatcattcttttcccctacaccggcatctatcatcacctaacagagtcatataatttacctgcttgtttgaccactgcagcactgtcccatagaaattttcagagtgatgaagatattctatatctatgttgtgcaacaatgtagctgctagtgtgtggctatggaacacttgaaatctgggtggtatgactgggaaaatgaatgtttacttttatttaatttcaattaatttaaaataaaatgccacatgtagctagtggctaccatattccacagtgcatgtttagtgtctaccccactagcatgtaagcttcatgagggtggagattttgcatattttgatcactgctgtcttcccaatacctaaaaatatgcctggctactaaagaaatacctgttgagtgaattaatgaatatgctgtgagatttccacacagcttctcattcaatcctaatgacagttttgtgggttggtgctattttcattctcttgtactgaaaggtaggcagtgtcttgctcaagatcacccagctagtaccaagaagataggctctgaatgcagggatatctgaagtgcagacattttgcttgtctggagctaggccagatgttctctgtggtcctttcttactctgagagtctgtggctctctaagaatttccccccttgaaaggcaatggcagcacatacattagtgtttattagattgatgggccttcttattcagccacttgtcaatggctcagaatccatggttctttaggtagagggagcacaatgcctctttcaacccagcctctcccaccttctatccccatcccggctcccatggctcaccggtttctgggtcgcagagctgctcacaggcatctgtcgtcctttgtccacagaggtccctcacccatggggaggtggcattgatctggtaatacagggaaagcttggccgggtttaaccagtcggagatgtccaggtagctcccttcactcaccacgaagctgcttcctatgggtgaacggagagacagatactttcttactgattttaaggtcttagctgatgctacagaacacagaaaggtgtgtacaagccacgttccccaggtcatctgatctcatttgtctaagtgcacttgcaatgtgcccgtcatggtgttgcaagcccatagggagatagaggcaaatcaaacatgggagataattcaacctagtgatgaaagataggcccttaggactgagagggaagtagggtcaaattcagaatctgcccttactaggcattgactttgggcaagtcacaaagtgcccctgggtcttggttacttcctctgtaaaggagaatattaatggaatgtacctcatggagttgataggggaatgaaataaattcatgtagataaaatgctgagctggcacctgacttattataggaaataatgattaaacattaaatttcaaaggaaaagaaaaaagctaatgtccctgtcactcagatgtctcctctggaacaggggtcattgatgtccacaggggccaggtggctaacatcaataggaaagactggctgagtgtgagggaaatagcatccaggcctcctcacctagcttgtgttgtttgtttttgttttattataagaaagacagaaagatatagagagacagactgagatagagaaaacggagacaaagtgagatttccaaagaaatccccagcacctctaaggaaaagagcagcactcacccaagaaaaaaatgccctgatgtggcaaaacaatagggagaaggagaaggtggggtttgggacacaataaacactgtaggctccattaaaatggagcagctatgactcagctccagcagctcttgccacatggaactaaaggctagtggcactagatcttcagattttcttcaggagaagctaaatattaacatttttattattatcaaccaatttttcaacatttctgatggctaacatttcttcttgaatacttgcgtaggccaatatttgctctaaaatgttccttatcccacatatatgtggaaacatacatatattatatagtactatattacatataaatgtataataataatctatgtagatattccacatacatgcacatgttcacacacatatacatacacacacactttttttgggaggcaagaaacagaagcccattcaggatggctgcatgtaagttgcaaatggtgagtgtatgcatgtatagcaataaaacaaaacaaagatagaatttcacagggggaaaaatatgtacccaaacagaaccaggcttcacaaagctggacagggagcgtgagtctagactgatggcagatctagagactgcagcagcaggagactttaaattgtattttataattaacatgactcagcttctctccttgtttctacctcactgtcaagtaaaaacaaagaaacacatctttgtgtatgcaattcaagttctccaaagacagactcagttaataagaatcatatgggttctatggaggtctatctgtcaggtcacatcttactctgctggctgacctatggttggactcctcttggctctggtgcacagctgtggtccaatgagcaatggccagggaggtgggatcacatcagaccacacctggctgtctgagcatctaagactgtgggaggagaagtttccctggaaatagtaagggtatgattggcaatgattatcttctctaattcacacacatcatatgatttctgtcatcctatgcaataaatccctaagtaaaggcacagtggacaacataattttggtgcaaaagaaagaggggtctttgtgaagtaggaggaatagacagtatcaggactgaggtaaggaaatgaccacatttcaagttggccctaaagtccttggcagctaaagcaaaaatggaaggagtttgttggattccatatttcaaatttctggcaggagaagatatgcaaatctatctgcaaagccatatttcccccctggaaataagcccaagcagaaacatgtcacatgggtccttgaggaaggcacagaacatcagtaccaactacagatttttctttaaaaaagcacagtcatgctgtttaaatggataattcttgtatttattctcactaaagactgaaagatggatattgaattgtgtcccagggctgagtttggttaaaccctctacttcaggaaagctacacagtgcagtgataaagagaatagaatcagcaaggtaagagttcatatcctcactttttaacttaccagctctgcaaacttgggcaaaaaaacaaaccctcagttatcatatatgaaaagtgtgataccaattcccttttcatagcttgatataaagattacataagacaatgcatttgtcttaggtcagaatcatcagaaaacagactcagaggcagacacaggcattcaggatgttttggggtacatattcttgtaagaggatgagcaaagtgggattgggcaaaaggagaggtcaaactgacatacagcaaatccctcagctgatcccatggggagatctggggctgggatggtccttcagtgatgttccaaatcaagacaaagatgtcaggactttctatcctcacattggccagtcataagctgtgagctatccctggagaggggacataatcttgtgtgaagtggtccctttcaaaggaaggcatttctcaaaaaaggactcagctgagagtggtcaaccatccacatttctggcagctggggaataagtgcctaggtgctgactggaaacctgagtgcagcatcatgatgtccactacaagctctgtgaaatctcaaggaacaggagctattttggttattattttgaattcttatgaacttagaagctctaaatgcaataccagtaaacagatttctctcaattatgagaaatatgggtttccatgaaagagattggcttgaaagcaggtacaataaatggaaagtttgtgtcctcccaaatccctatgttgaaacctaatccccaatgtggtgatatttggaagtggagtctttgggaggtgattacatgggtggagcccctaaatgggatgagtgtccttatcaaagagactccagagagttccctcactccttccaccatgtgagaacacagggagaagtggccatttgtgaataaggaaatggacccttatcaaacacttaatattttagcaccttgatcttggaatctgcagtctccagaactgtaagaaataaatttctgttgtttataaaccaactgctatagtagactgaacaaactaagacagcagtttatccttaatgtctttaaaaagatattatgcagagttatacatttggtttaatggcagaagggagttactatcctttgaatgtcctctgctcattcgtggcatgaatgtgatatgtattctgctcatttaatccttacaacagcctttcaggataggtatttcttccaattgaacatgaggttcagagagaaattgacatggtcaaatttgcacaaccagtaagtggccaaagtggaacttaaaccaagatttttcagccttcgaagctggaacatttgcctttcttcaagctatcttgaggctcaggggttttggtcagttgctttttatggtccttttcctctgtctagagtagtctgtgaattcctctttagtgcatatcatgtagagttggagggcttttgctttctctcatagaccgtgatttcctacagagaagaggtcatgactcgttagtccttatcaatccaactctcagtaaaatgcctggcacatactaggactttagtgaatgtcaagtgcattaatgaaatcagagttccatgcttgactagagggaagttcaattcacttcatcatggaattgtgaagcagaaatgcctccacgttgatctcacagtttaatttttccatcctgtgagagccagaatacaagactagcccttcagaacctccccagttccaaactaaatgtcgaacatcactatcgtggctcctgagctcttattcacccaatgggctcatgatgcatatggcaaaagtagagaggcaggtagagaaactcagtgacaagggtcaagggaggtgccatatcagagcctgaaaagaagtaactttgtgccaaatttaatgtaaccatttacccaacgttgattaaactccttcctgcgtaagaaatagacatagagactaagaaatgggcttaatccattgagaaagttagggataaaacaagagagatcaaatatctgcccagatatctttaatacaacctacagtgtggtaagaattgcctgaaaaatataggcattgtctttggatataagggagaggaaaaaggggactcaaagaggaacattgaagagttggcctttaagctataccttgaaggatgcaaaggagaccatgacataatgaactgttccctccagagtaagtgggagtaagtggccacctgtgtggcatttaccccttaaggctagactccataactggcctgcactactcttaatctctttattatttgcaaggcactccactcaagtagcacctatatgtgctgtgctagagtgtcattcattcactcagatatggctatgcgccaagccctgcagcaggctctggttgagtaaaatatggcgtctgcctactgagaacttatagcccagaaaggaagatcagatatgaaaaatctaaggcaaagcatgactgtctgctcccctccccccatccctcactttccttacttatttgcccatcagattgtgcatttcttgaaggcaaagcccggcttcatttaactctacaatcactgccatgcttagggtgaagttgaggttcagtgtgggcatgtgagagagaacaagagagaaagagagcactaagtttaaggaatgtctagcagagctctctgaataaattccatttatttgggaatacaaactacacagaaaaggaataaaaggcactattccatgtgtctcatgtttttctagtttttctttggacccttgttttattttttggctttcaattaaaagtgtcctccccactttactgactgttctgagttcctctctacactcatatagatctccccagagagcaatgactctgaaataaatctctgccaaaatctcaacttcaaaatgtcatgtttccttatttttaaatatatatatatatatatatttttttttttctcccacttacttgtgggaatatacatcatctaattagctaaatggattttcagttcagcccaatcatttcgttatctagcatctgaagcccagtgttgctcaggggactgcacgggcacggaggtcctcattaactctgatcttcaattacattgattatcagcctgcttctgtaattgtgcagcatagatcaggggtgagctggggagctcaggccactctgtagcatactctgaaaagccagaggcacatcagccaccaaagaaacagaaggctacagatgagaactaaaaataccacggaaggaggtatcaccagacaaaattgcctggagagccagacagcagctgcaaatccctttcattacacctcacatcatgaaatagacctctgagaaccatggatagatttcaaaagaaggctctggtcacagtggcaaatggtgagcagaataatgaaagatgtgtggctaaaagatggtctttacaaatgaagtgtagagactgttttggtcaaaagttttcatttttattttccctctttctttgggtaaaaataattaaagattccctcccttctgttacatcatgaataccacgggtcctagctgtcttggacctgggagaaatgtcttcctggaaacaagatgaaaaacaaactgtgtgatgaagcaggaatgaagatcatatctactatcagcccgacagacccaagaagaatgtatcacttttacccttctcccaggtccacagagccccaagtcaggctttaatacattccaccacctaccatcaacagaaaactatttacggggtgggtgatagaactgcaaaaatgtggttaaaaacaagcttgagggtttttgagtatgggtaaaggcaacctggatacctgggagaaaacagtctctgagagcaaccactctggaggaacattatcgtgggggtggttctcctacaaggatcttcaagagtcctcctccggttatctctgtcttcacttcctgaccttccactcccagctctttcctctgtcatcttctttccttttgccttggatcaaccccagccttcttctattcttctctatggttcctacttgttatgggttggactgtgttctgccccaaattcatatgctgcagttctaacctctagtgtctcagaatgtgactgtccttgaagacagggtcttcaaagaggtaattcaggttaaatgaggtcattagggcgggtcctatttcaatacgactgatgtccttataagaagaggatattggggcccaggtacacatagaggaatgaccatctgaggacacagggagaggacagccatctacaagccaaggagagaggccccagaagaaaccagctctgctgacaccatgatctcaaacttctaacctccagaaatatgagaaaataaatttctgttgcttaagcaactcaggctatgaaacttttttctttatggcagccctagcaaattacctctatcttatttctttttgtttgttgtttgttgttgttgttgttgttgaaacagctctaactcacccaggctagagtgcagtggtgcgatgactcactgcagcctcgacctccctggctcaggtgatcctcccaccttagcctcccaggtagctaggactacagagacactacaggaccatcacacctgactaattttttgtgtttttttgtagagacaggattttgacatgttgcccaagctggtctcaaactcctgggctcaagcgatccacctgccttggcctctcaaagtgttgggattacaggtgtgaacccctgcccttggccacctctgacttctttgacagcaaatatctcaagcttgccatttgctccacttagtaacctttattttgtgcttgggatacctatgaatcacttctcagaataaagctttcaaatgtataaaaccaaatttatagtataacaaatgtcatgaataagtgaagcacagttctatcaatggaccccctggaggttcatggagctcaggataaaaacccaagtctgaactaagctattttcatccactccccagataccaagtctggtgtcttttctggttccaaacacttccaacatcactggatggacagagggattattataatacccataaagtgtgtgaatcagatggaaatgacaaagcgaagaaagaagctaagaaaatgctgagatgttccagtggttattttaaggacagtcaacctctttctgttaattttacatgaaagtactttttttttcatgctctgaagaagatagcaacttggttaagattggggtttcctggaatcattatacaacagattagaagtttatggtgttatgctagttatatatctaattttacagactatcagaaaaatttgagtctttctagtccagaatctctcaacttttaatatttttatcaagtgtttttagacatttttccttaaccacctcccacccatgaaattttaataccagagatatattgtatatctgcttatacactgtatgtactgtttatatactatgctttcactgtacatagattaaatattttcactccctccccaagatcaatttttacttctttggggatgttatgtccttattgagaatgtatgttataatcagacccttttgcagagataaggaaactgagggtcaaggcaaggggcaggggaggtgcccaagatcccctctgggattagtgaagtagccacagctagaacatggactttgtgactctcaacctcttctggtcatgagggaggtgggagtgagagaagtcaactgactctccaagagccacaggtgtcagggctagaccagaatctaagtgccataacttctaagagctcagagtctgtgccagtatcttccactgacaatcaagaaccgtcctggtggagggaaactgtcactgggctagagcccagtgggagtaggaaatgctaataactgtgagaggaccacttcatagaagagacattgagatctcatcactgcatatcccagaaaaaagaccatggagatgaacagtccactgggatttggggtattctaggttttatatatatatctatatctatatctatctatctatatatatatatatatatatatatatatataacctatatatatgttacatatatataggttatatatatatgttacatatatataggttatatatatatgttatatatataggttatatataggttttatatataggttatatataggttttatatatataggttatatataggttatatatatgttttatatatatatatatgtttttccaaataaagctgtatcaaaatacacctatttccaaatagacatcttcctgaagtgctgtgcccaaatttgctccaggcaaatgtgtgtctactgttttctgtcttccctacctcagacttgtgatcaaagtctggctgaaaacacgttgccacagaattctgcatgcctttatgtatctacggtcttgcttcaaagttgagttaggggtgtttgagtctggacaaaaaaggtttgaagttttgacgtttcaaaaaagtatcttttcccccaagaatacagcagtttggtaccaaactaggcaatgggaaaagaataaagtcatgacatgttttctcatttttctttaatcatttaaatttttaaagaagaattttggctgaaggttgaaagcaactcttttcttttaatttaattctttctttattttttgaactctttttatgacttcattgggaatttaggcatcagacccaattttagtgttggatttcttttttaactaagatctgtgctgtttgaatgaacatggttgacgactactccccaaacccaaaggtgatttagctctgaattcctaatactgaaaaatctctctccatgtcagttgctcaagtaagacacgaacttagatggaaactttgataggagtctaacgggaacagattaaatctggcccagccactgagttgctgtacgattctagaacaaatcacatagtcttggtaagcctcctgcatttcttaatctgtaccatgtgaataatgcttacttcatagagcttctatggaaattaaataagattcatttggatttcctatggatagtaaagttcctggctaaggccttcatgtttttttattgtagggacaaaatgtacatgataaattacacattccatttacaattgtatatctgtctgtatatacaatacatattactatatattttgcatgtgtatatacaattggtaattgtgtatgtccatgtttatgtgcatacacacttgtacatacacataagcacagataattctgtcaataatgtgtcctatatagatggtgtcttctgaaattgtgcaacatggtgatcctccttgggacacagccagatatcagtctcattaaaaaaaaaaaaaagtcaccttgctctcacttacccaggctagactcattttttctaggctgacttatcctagcagcttttcccctgattgtcacaataccctgggatgatcggcgtagggtgggaatgagggaccctacttgaagacatgttgcgagagtgaggaaccactgtggggtcctagaagtatgcctggcatatattaggtgcaatacctttggaatgaaaatttatggtaagacatgaatagctgagtaaattaacaaatgaatgagtgcaccttgtggcctacaggacccaccagcttcactatgctccctgcagcctgtttccacttcttagggtctacccttttgtatgagatgtgcttccttctgcctttcccaagaaatctgcagaaacatcaggagctgtttggaaaagacagctcacaactgtgagcactaagaataaccatattagcaattcttccccaaatctctttcattactacactgtgggttcgatgccaactgaccaaattaggcataggcacctgcctgcttgtgtctcttgtgtcagtgtgtgtatgtttgtaagtgttcctttttctctagatctcttcctttctactctcttctgtctggaattggcttcactggaaaaagcatagaccttgaagtgggcaggcacatctggattcaaatggtgccttgacagttcatcatttgagtgaccctgggaaatgcttgatatttcttttctctgcttgctcatctaaaagagggtgaatagcacttatcttgcagtatttgcaaggtaaatgtaagtctgtgtctgtgcctcactcattgaatgcacatggaaaatgggatttttttttactactgctattgcttagaaataccagtagagggtaggtgttacttttattcccattgtacagacaaggaaattggagctaaaagaggttaactgtacatgtcctaaattgcacagctaggaaactgatgattcaaaattagaatgcaggctacctgactctgactccagagctctgttaacacatggctgcctcgcattctgcttgcttcaaggaaaacctatccacatcactaagatttctggttgttgtatttttctttttcgcttctgtcaacatacatctctcattacttctgtaaatactgagcttctcatggtggtagctggaacataaatcataccatgttgaaagagagggagaaaaaaaaacaaagaagtcagggagaaggtgacataatattgtaattcaatacttaatatctccaaagacatgtaatacatcgtcatgacattttcaggagatattttctggaaattggacaataattcaaattaatgctaagcctaaatctaattattttatgatgctacaaaggactacatggggccaagcatccaaaaatcagcggtttcaacagtcatgttgatgaaacaaatttcactgccaggcacggatgagaacagctgcctaaatatacaatattaatacctggggcaatgtaataacagggaactgcagcctagccacactgtagccttctcagcaaccagcctttcaccagccaagtcctactatgaattctgggaaaggtaaggagataaaaaaataaggtttttattcgagggccaaatgaaggccctggggatcaaataggacccagggtggctgaggtccacgtttctggtatatgtcgcatgaaaggtgaattcccgtcttctgttcctggaggcagctggtgaaatgtagtctgaaggagccagtccctggagccagagaagactggttggaacaccagccttgccatttaccacctgaaggactttatgcctatgattcactctgtgaaccttgcggattctcttctgtaaaatgggacaacaatacctaacatataactcctgtgtgtaatggcacattgagatgtccatggttcatgaaggaagcaagttgcccgaaaatagataaagtatcatctcagatttgaaataaacaaacataaaaatagccattcagggtttctgtgtgtgtgtgtgtgtgtgtgtgtgtgtgtgtgtgtgtgtgtatgtgtgtgtgtgtagcaaaaattctagaaggaaatacatcaaaagggtaatcaactgggcagactaggattggaaatatcctaggaataggaaagagggtatatttaatatgtgcttcatttacacctatattacctttgtaataaggatactgatgatggtactattactagtacttctatgatattgaaaacagcaataacaccaacttcagaagatttgggaaggaagaaagggtagaatatatacaaattgtagtagtgagtcaaacacatagaaggtgatgaaaaattgcttttttttttttggtctctagctaattgccaagaatatgttctccctctgttggaagagtctgaggcactgggccaagataggtggaaattgactaaataatgccactttcttcttctcactcttgcctttgtcctcatatcctgaagtttcctccttactacccgtatcttcccagattatactcatttatcttccttccctggtcccatcacctggaagtagcctgtccttcctctgtcctgaagcctgctacacgcatctcttttcttatatcggtatcaccactgatgcatttgaatttagcccacactttcagaggagtcagcatgtggcaagatttagggcatgctggtgtctcatctacctagggagagagtgagttttctaaggaagaatccatatctaattcatctttaaaatggcatctctaagcacagcgtttggcccttagcgtgcaatcagtaaagcattttgaatgaatgaatgaatggagtgacaaatggtgctttaaggcaactatttgcagaatattgccatagatgttatcaaacggaaacaaaagagacaaaccccacagttccctccccacactctccagtggcgcttcaggttggggtgcagtggagcaatcatctctcaatgcagccttgaactcctgggcttaagcaactgtcccacctcagcctccttagtagctgggactacaggtacatgcaacaatgcctggctaacttttaaattttttgtagagatgaggtattcctatgttgcccaggttggtcttgaacacctgaactcaagcaatcctcctgtcttggcctcctaaagtgttgggattgcaggtgtgagccaccatgctgagcctttttttaaatgtgaagtttctgacatagaaaataggttgggttctattttcagttggaaccaatggtctagcaaatgatgagctaaactatgggatacataggacatttggagtgtatttatgcttttgctatcaaacctaattgtcctttctgaggtgctaatatctggaagagcacagctaaatagccaaaccatggtttatgaatccagaccaaaccccatggggcattcttggggtttacacaacaggaatgggcatgcgcagagaccctataaaagatcaaacaaagttaacatcatctcgctctttcaaaaaactagtcaactgctattctttgttgttgtcaaattcatttagatgaggaagtctttctgttttttataaacagagagtccagggtaatgtttaatagcagaaatacagagcgaggcagctggtattcacgttctggccatgccactaactaaccaaatgataatgatccagttaaatgggccttggttcctcagctataaaaatttggataacaatctcacaggaatgtgggaggtaatacatgtaaattaaatttcccttgtttcagattactcacttttagtataaacgaggtaatagatgtaaagtgcttaaaactgcacccgacacataataaatgctggataaatattagctattcttacactatttctacctacatatatttgatagttctactgtgaaataaaagaaaatgttgccttgttcaaatacagtttcgcaaaaacaaacacaataaccaagactcctgcttgaacaacatattagctttggatatagcagtgtaatcaaaagcccattctgtgactcatttctactttcctaattgcctgttcctgctctggtcctcagccaggagtcagtctttagccacacatggatatatacacatcagattgtgtgtgtgcataaacaagaacacacaactcctgctgcctctgaggactgcaaagaaatgacattaaaagtgagtgatttgaaacaactgaaatttaattaaaaacaaaattaaaagttgttccaagcctggcgcttcagccagcaagactcagaggaaattagtaagtgctactaatagctggatccaattcacaacctctatgagaagacagtcagagcaaagaagatgcataccctttagatgaaacaattaaagatcacttctgagaaatagtcatgtacagtatcccagggcaaaaaaaaaaaacaaaaaaacaaaaaacaaaaaaacaacatcatttgctgatgtgttcctctttgaattcctcatttctattaagggaaagtgccctgagattctcctagtagcatcttcaatggcaacgcactgattttgaaaactagacttaacacgggaggtgggggcaaattcctttaaaaaatgttgtcatccactgtcctgaaatttcaccttgcaaatttattcatcctttgaaattccaaatagtcaaggtgcttagtaaaatggattctcctcaaataatgaagacgattgtcagctgggagttggggactcagcagcaggatagttaaatgtgctggctgcaagagtgctatggtggatggaatcagagtgggcagtgggcagtgggcagaggggctgcgtctgagatgaatgctcagaggcaggtctgagaagaccacctgtcccgggttctcagggtagcatggagagaggtacaggagaaacagcaaaaactatgacagtaaacaggaagatagtgaaaacaaatcaaacaaacatacgacaacaacaacaacaaaactgaagacaataaatgagaggggtggggtaaaggaagggggaggaatgactaaagctgtggcattgaaagtcttcatgagcattaactggccaggagtggaatgaaccagcttagcctaaatacacaaaattggagcagacagtacaggtccctgaatcaaagaatactgctcagagctctaccttgctctactttcctccgtgtccttgtccacagaaaggaaagagaatgcccattccacagaaaagctttcctgtgctcacttctacaactcatcacccagtctgccccaaccacattgaccttgttccaccttgttcaagtcacccaaatggttttgactgtgttgtttcctctgcctggaacacactttcctctaccacacaacttcacatgttcctttaaatgtcgttttctcagagagatcttccctgaccagcatatctgagccttctatcccaactctcctctattttaattattttacaccattttaattatcctcacagccactctcacctgttgccaatgcttacttactttattttgctaatttgctttggtgttcgtctcctgctgagaatgaaagcatgctgcaggcaggggctgtgtcttttccagcacagcatcttgactgccccatgacacataagaaacaggaaataaatatttgttcaatgaatgaataaattctgtaaagattaaaaaaggtattataggtagaatacctagcatactgcctggcacatgatgaattctagctgttattttcataaggatctaatattatatggatttgcattctagtggtgaggttgtttccggaaggagagaaggatggggactgaaataggactggaggcctctagatgccaacttgctgtcctcacactgtgtttggaacatgcaatatggcataagcacgcacctgttgtctagatggatcttactgagggtgcgaggttggggaggggatgggactgggcgctactgagggctgatgctgcaggtcaactagggagagaggagaagctgaggccaatttccttttgcacaaaccagtctcatcccatcctcaaacgagttcttcaaggtggacaatgaatctgtccaagcccaacttacccttttatgctcatctcagcttctaccttctctaagaatcttttgatgtctacctcagtgagaattaccttctctatcttctacccaactcctcatgtagctttgagagcaatgcagcttatgtttactgggctcaagactggttttgaagagtctacctcattgtcaaatcttgtgacgtaattttgggtttcaaaataaaattgcaaccaataattcaataacaggaatcataattacaggaacggtattagatgtctcagaattgtttttttttaaaaagttattgttaaaagtatcctgaatagggaacagatctaaatatactgagctcccactctatgttgaataccgtgacaaaagggggtggttataaaagtggaagaaagagtccctgcccgaaagtagtgtatggttcaattgagagatgacaagatagaccattataatagaacataatcagtgtagtgataaagataaaacaggaagctttgggcacacagagcagggatgctcacctcctctgcaaagtcagagaatgcttcctacaaacggtcacacttgagctgtcacacttccttatattgagttcaatataagaaagcagctaaatggagtagaggggtgctatgctttggctgtgtccacacccaaatctcatcttgaactgtagctcccataattcccatatgttgtgggagggacctggtgggagataattgaattatgggcagtttcccccatactgttctcatggtagtgaataagtctcatgagatctgatggttataaggggaaagccctttcatttagttctcattctctttcctgccaccatgtaagatgtgacttgctcctccttgccttctgccatgattgtgaggcctccccagccatgtggaactgtgagtcaaacctccttcctctaggattaccgagtctcgggtatatctttattagtagcgtgagaacagactaatacaagcggcaaagggatttaggcaaaaggaaagaaatgctgcaaagaaacaaaacagagtctgggccttcaggaaatagctatttcatttggcctgaggatgagatgcccaaggaggagaatgggctaagattaggctcaaaatagtttctggctctaacattctacactttagaaaactgccaactagctacttggcaatatgcccacaatgtgccctcacccctgtactcatgcccccccttttggggtagcagaagctgccatctttaattgattccacatttcaagtgtgacaccagctcccatcaccaggcctctgtatcttttttcaggcctctgcttccatagaaagtccactgcccagcacattaatgcttcatttgagtctttgcagggaatggctggccctggaaccttgaaactcataggtcatgttaacactcatgtgggtgccacagactgatcactctctcatcctccaccctggttcaaatactgcagtgagatgtcacctgagatattactccagtgattcaaaccttcaggggagcagccttcagagatccggcaaattaattttactcgcaggacacagtgacatctcctactaataacttttatccaggcagcatttgtaaaggttctaatattgtggtttttcttttttcttttcttttctttttttttttttgacagagtctcgctctgttgcccaggctggagtgcagtcgcgtgatcttggctcactgcaccctccacctcccaggttcaagtgattctcctgcctcagcctcctgagtagctggactattttttgtatttttagtagagacagggtttcactgtgttggtcaggctggtctcgaactcctgacctcaagtattctgcccacctcagcctcccaaagtgttgggattacaggcatgagccaccatgcccagcctattgtgtgttctttaaagttgcttgtatttttttcttttctttcttttttttttaaatctaaatatgtagccaagaagtaggcatctgatctttggtctcacatcgggatgctggtgcttcagcggaattgtaacagtccctagtttttgagtgtggttaccatgggccaggcccttgaaatgaacaaccatttagttctcacaataacagtctaatttctggtgttttagcatccccatttttcagaagatgaagcttagttaggatttgaacccatgtactctggcattggtgttgaagctcataaccaccacacctcacagctttacaaaaaggggattattcttacaaggcttcctcaactcaattgggcttcttatgttgattgatgtctggggtcatcaacctttcagggatcccaggtggcagatgccacatcatctttgactcttcctcttccttggtctctacttgtagttagttgctatatttcctttttctagctctacaggaactcttttttctttattttcacatttaatgcccttgttcaggcattatcttatgaactcaatatggcagcgcctatcaggttccttgtcgccagcttaggcaacctcagattcacctttcacattgtgatcagtcattaaacaaatctttattgaacactgattgtgtactggggattacaaaggaacaagacagctacactctctgccaataagggccttaaagtagctttggaaggggctattgttttccaagtatggaatatgtgctacgcaagatcaccctttaaggtggtttactgtgacattccccatttcacagatgcacaaacgaggcttagagaggttaaataacttaaggctacatagctacaaaatatcagaggcaggtatcaaactctggcagtgagattctgtagcccagactcttaaccaaattagacattgaagaagtaattgcaaatgtactgaatgcaaaaagtagtagttcaggaccatttaacaaggagactcgacttagactgaaaggacggtgatggcaattccaataaaaatgaacattaccaagtactttagaaatataatctcatttgattctcccaaccctacagattaagaaataacccagaagggttaagtaacactggtagcatctattatctattatttcatgcagctagcatttgaacctaggtatgtctgactccacagcctgaactctgaattaacaagctgccttgccctttgtaaaagcaactgtgactcttccactccttttattaaaatccttcagtgcttccataactcccaacctccaggataaaatcccaactgctcttcctgggtaaaccctcccattagatccattcatgcccccatggagccccagccttgctgggtgctacctgctcctgccacacctttgctcatgctgttctctttacctggaagattgcccttcttgtcctccctctctccccccacctccaacagaagtgcacattctcactcccaatccctgcccatccagtttcctcaaatgggaaaagatgctagcagaatcctcttgctccttgaagctttacccagatctgcccagtggaaaagactccaagcttccctgacaacctggctgactcctgtctatatgtcctgatggttcagattatcatctaccttccatagtagccttttgctatatagttatcctaacattttaaatgacacatgtgatccctgtgagggtgtgattggcattttctaaccacctatttttggctattgttatgccactctctatttcaccctcaccaccaccctgtgaagtaggggcttatagcttcactttaatagatggtaaaattggtggttctgagaagtacagtgactcgtccaagatccataattagtaagtggaggagtgtagatttaaacctgaggatttaagattccaaatcccatgttctttcccccacctcacccacctttaatgctgactgtgcctgagttaatcccagaatctaagtctggccctgagcaggcactcagcaaatgtcagctgaaagtttgaatgtacagactcactgataaagtttaaatggaagccagagttaaagccagggagtgaataaacagaaggttcaaggatggtccaggctctggggatcactccagctgatgatgagatgccccagccattagctgaggttcagaaagttgccaagagcttctggaaaacccaaggctgagcagctgcagatatatttggcttacataatccagaggaatgtgctggggagaaaagccaaatagcaaggctttgctgggtagcagcgctggggaagggggagcaggatgcacaggtgttaattattcctcccatcttatcctttcccatgtgaatacaatgcattcttcccctcccagactcccactggcatcagagatgctcaaggtccctcttcagctggggctgagaggggaagctgcggaggggccaggcttcccactactttatttttcatccaggcagccttgggagcctgaagtccctccacaagcttggatgtgatccttctaagctgtcttcaaatggcaacttgtgggctcagctgtttgctcagctgtctctgctccctacctccctgttcagggggctgcatgacagcagtttggcccaaagcagtctgaagacagagtacctgggacactaatgtgatggctgcataaggacttggaaggtcatgtccatcatgagataagtaaaaagggactttgaaccccagtatttctccctctccatttaagatactggggcagggaagaatcttaagtaccaccttgttcccctcctacattttacaatgaagaaactgaggcctgaagaagtagagatttgtccaaagatggagtgaattcatagaggagctggaggatgatcttagtcatcaaattctctatcacattctgtggatgttgattcaaaataattctgttcaacctcttcccacctgtgtaacactaagatggtcatataacctccctaggcatacatgacctttcaatttttatgtgtcccttaaatttgaggataataactggatctacttcatgaggtaatagaatgaaacaaggtaataccttgcaaagtacttagcacaggacctggcacttagcaactcttccgtaaacatttctaatcattaccagtgttattgcaaccattgggaggtttgaaaaacaggatctataggatgcactgacatgtgtccatgcccctccctgggaagcctgcaatcatccattgcccttctccagataagtgtcaatggctctaagatgtagctcaagtagcacctccttaagacaccttcttcccatctccagcttgggatacttgtgtgcccatcggtgtctccacagcatctaggacaatcccattatgaatcattcacactgagtcatcatttattgacttggcatgtcccaccaccactaagctggagaaggccggagatggtgttttatctgtctctccaccccagtatctgagcatgccacagagagtatggtatgcaaacgtttgttgaccatgggaggaaaaaaaaatgaaggagaaaaggaaggaagaaagggaagaagcagaacactatataagaataaaagagtggtgttattaatgcattttaactatctatcttccttcttctagccaagggaggccaacccccctaatattctaccttttccttacctagccttacctgccaagaccctattccaaccctaaggttttctttatacatattaaagctgcaaacagtgaggaaaagtcacaacattctcataatcataactaccctcacagttgacaaaatacttttaaatgaatcagcccactaatactctttgaaggagggagtattagcatgtttttagatttaaaaaaaacgctgaagtttaggaggggaattaatatacccaaggtcacaaaactagaaagcagatgaacaggtctggaatgcacatctcctgggccacagatcaatccacttaatgtctttaccatactaccttctttctcctgtggattactccactgcctcattatacactatttggcaaaccttaagccaataattatggaacaactaactctatagacttgaagtcaatctcatcaaagctcccacccagcattctctctttccgttctaaaagtcaaagtggccttctgttcacaacaacagaacggaattattaatgagagaaaattgagtttgcctactccttgcaacaaccctctgccccagttcctgggaacatatttttggactcaatctgctatcaaaacacagaaattagtctccaattttggacgtcaaactcagttatctcttttgttatgaaggaaaattagtaatgattcattctggttggaagccaagctaacatcttagcacagagtgtcattaaaaatcccagtcccactggctgctgtggtatctttaaaagcttgaacatgttcagctgcttagaatggtttttctgggtttgttctcccccaagccacttgtcattttaacctggggatcagttactatttaaggcagaaaatggcttaaattttttttcttccatggttttatggatttagacattcctaatgaagagatttgaagaaaaaaaaaaaagaattctactctagggggtatccacagctcccagccattgccgagcaagttggccattaagtacaagaaaaagaagaagtgaaaaaaagttttcacagtttataattatattaccaatttcattacagatctcattttaattctgactgaagcctagccttgccttctccctgtactctctcacgtatagttattaagtctgggttggagttcaagctattctccctgatttcagcatattaatatggtttattggtatttcattgccacctcccctatgggggttctgaatctcagcccaatttatatttcccctctttctgggctctgggatgaagcttgtttcattttggtgttgaggaggggtgtgtgaatttgattggagtttatttttggggatgggagcaacatccttggggagtgaagtcaatcatagaagaagaggcagcctcagacctcctgcactgtcattctttttgatgtatcttcttagggcttctgggtccaccgtcggtcctcccttacttcgttttttacagacacaatttcttatatgcctactgagtcagaatccctgttaggcatcacaataagttagaacatgaataagctgtggtccttgcccttgaaaaaatttaagtctaaccattgaattaactttacaaaaaaattcagtgaaagccttttagcgggcatcaagtatgttttggatcctgtccaaggttctgaacataatgtgcaaaacaaatgtaatctctatccttatggaacttgaaacctagcaagagagaacaacattaactagataaatttaaaattatacattgaaataaatataatacagaaaaaaagcagggctcaaggagaatgattcataagggagctaacagaggcattaccctagggtaaatgagagaaactagagatgtgggaagaagttttcaggcaaagaaaacaccatgtgcaaagggcctgaggcaggaggcaacagagaaatttaagagccaatatatggagaggtggtgtgacgtaagactggaaaggcgggcaggggcctgaccttgcaaggatgcaaaggccacaataagaagttcagtcttcaaaacaagtaaaaaagaagacaataaacagatttatggaaagtatgacacgtatgtaatacatgtatgcgatgttttgatattttcattgtaaaagatggctctgtttgcattgttaataaaagataggagagagcctagacttaaagcaggaggccagttttcaggactgtggcagttgtctcaatgacacatatgtaacagtaacagtaacagtaataggagttagactgaagtcattagaaaggcacaaatataattctaggtaatgttcatgagaggtgatattatttgtctctaaggattcattgaagaaggttttctagaggagggagcaaactaagttatgccttagagatgggtgagactgccatatatggaaatatatgatggagaggaatgtacaagcaaaggtatatagagaggcagataccaggtaggacagtctatttgtctaaacagcatcaaggctgtgcaaatgagttaacaaagaaaaagacagaagccatattgtacagaacttccacccataagcatgttccacagtattcaaagatctgcagtcaacatggagcattttaaaacaaagcctgggatgatttcatagagcaggatgtccaaggaactactcgttttaaataaagtgcttggcagtttgtggctaaggatccacttacaatgtggtgtcattttcccttctaagaattgaaaatactccttccatgtattcaaatcactgcaaactagttctgaagccaattatggacctctttcctctctaacagcacaaagtcatgcattagctcactcttctgggatggaggacatcaagtagggatgagagcaaataaatgtagacaagtgttattattcacaattttatgctcaaaaccagctacatgtgtggcatattagtgaaccatgccatcccaatgtgtgggcatttatacttgatgatttcatgggctaagaagccatactcagatcccaaatatctcagtcatagggaacagagaagacttggatatcaacttagttcaacctaaaagatgatgttaaccatttaaaataacctgaataaaaagacattttagcataggtattttgatgcaacaatcatatcaatatataaaattgtgtgtgtctgtgagtttagctaagtaacatattcaagagacacagacatcccttgttttcacccatttctgagcctacgcaaagaattggtgacactctgtgtgaagtactaaggaataaagaaacatattctaaaagtcctaaaaaattaagtggttttaaaatttacagtttgataatatggctccaaaacaaaatatcatgattcaaaccaaacgcttctcttcccctctcttctacagctttgtaaaaatgtggtcatctattctcaggagattttctatgatggggaactcattaccctgcaatgacccccttccaatattaagaaaatattattactacttctaacatttatataatttattgaaccattactaggtcttaggtattgagctaaaagctttatgagcattatttcacttattcttagcaataactttataagtactgctattatccccaatttatagataatgtaactgaagcttaaaatgtttaagtaactagcacaagtcacacagtcaacagtagaggaagacgtttccaaaccaaggcttcatcttctcccatccctgaccatactcattacccatatatctgtctagttttgcttccttaggacttccagaactagcctgctctcttcaaaataaataataattatcctggtctcctctctggaagcttagagcatagaagaaccttagactgggggctcaggtaggcttaagttttcataccacgtcatctatgtgttaatctcgtaaaaccacctagcatccctgagccccacttttcacgtacgcaaaatgaggatactaaatccagactctcaattttgctatgagaactgaaggaagaaccctgtgtaaagtgctttgtgtgctactcaatagataacagacatgctcaataatagtaggttcccttcctgtctaggttccttcaacgcttgttattgaatgaatgtcttccatcctttccttaagaggtcattaggtatctacagtgctttttcaatcttgtggctgccaaatcctctcacttgaataacttccaatgtataacaagtcttggaacaaaacagggaattctaggtggactgttacctgcctacactggagtggaaccatctcacctacttcacctagatagcttgttcctttaaaagcagactcttctattggctgaccacattgggtgaatatatgcccacttacattgggaacctcagtagatgcataaactagcatctcagctaagataggtgtttaatattaaccaataactatttctcaatgaggctaactgcatggcaattttgatgaggtccaaacctgtgtgatcagggttagtatgttataaaccttaagaatagaccactcacattatatccaatgctaatgatagttactggagttatgctatgaggcagctccattagtagggcattgataaagtcaaaggtggaggaaaccaaagacccttattaaagatgcttataatgattccaaggagtctgaagaagtgatcacatatgttagatggaaaaaaagtaacacttaaagaattattgacacagctctcgaagccttgataagtgaccacctagagagttcttgtaaagaatattaatatgtgggctctaccctcagagaatctgactcactggttctgggaattatctccccagataacctaaatgcagacgatttgtagttcacagctggataaacaacactagcttaagtctgtttagatgcaaacatgttccatttcttcagtgtgtgcttaggagggcaaaaagccactgatggctttgaagaagcccagataaaagaaggggtgagatttgccaagggtttggataggaactgtgtcagaactcttgccagctgggctctggacaagtgctatgtcataatgaccttttctttataatcgacagtaaacattgagtataactatgcagtaacacaagggcagaattcattttctcctggaagacaggacccattactcagccccatccaatgatccagcaccacggacagctcaatgtgtaatggtagctgagagctctctctactaagaagggccagcacctgggcagcttggaactcatgggggtgactgaaaaaggatgaaagctgctctggctttggtccctgggagacctggtctcaaatggagcttcttgcacttgacatgagctgccctcatcctgacagacctcattgagactttgtttttcttgttttttaaaactttgccagttttaaggggccagtattatgatgtgggtgaatacatatatgtaaaatatcatagaattgtgcactttccatctgtgtttgtcaccacatttatgttaggttgtaacacatttataaatatcaatgctaacggatgacatgggttcaagaaaataggcactattatcgctttccctctcatccccctatgtaataccctcatatctccagaaatcagagctggaaactccagtagtacaatttataaaatcaattttctagatccttctctactcctacagaagatttgattctactccccttcatatcccagtttctgtatctgccaaaggtggataataaagaccactttggagagctgttggaggaatgagatgagcagcactgatagagtttctgccaaaggaggcattgggatcatgctggggaaggtgagcttgattgggattaccagacagccatccacctggcttcaaatgctggatgctcccaggattcctgccaagccccagagatggaggagtttcaagtgttaacgtcttcaagtgggaaagtcacttttggctggaacagagcatataatgtattcccttttccattcacctcactgagagtagctaaattcacctatttagttttctatattttcttgccttgccatattccagcttctgaagtctctttctctacaaactgttttaataataagagtaataacagctaccatttgttgggctatcacaatgttttagacactctactaggcactttatacacattataacgttcaatcatcccataataatccttattttacagataggtgagaaaaatgagactcagatagctaacttgactcttctatgtttcacagtaactaagcaacaaaattgagatccaaaccaaaacttacttcatttgaaaggacacattcctaccaagatattatggcatgtaagggatggagattccattatgcctggagactaagatactgtggacaaggtcttcccaatgctgtcttctaagcttgctccatcgcatctccaggatgtgtatactccgtagttatttctctttttcttttgtattaattatattttcttattttctggatgcttgatgctctggcatctgagcctcctgactggggagaaccctcccctccaaggatagtcatatcttacagaaagcaaaagacttgtccagggagcatccctttcatatgaaaattaaccaatccagaacctacactccaatcatctcctctatatggcttatacacattgggaaggaatattctctcccttcatccccccagggccagataccaggcaatcaggagcagttctgaaaccccagagcctgctaaagttattcaaattggccaatctcaaatctgtctatcctgcttacactgcctcacccatttcttcctgcaataaccataatacaggctctttcccctgctttccacttggtccctctgcctgctgatagatacgggtgctttcccacatggtctgcatggtgtgctgtgcattgtgtatctgagatctgttagtatgaaaactgcttgtttcacaacagtcctttcggcatctgcagacaaatcctgggtacattttaaaacttcacaggtatattttaaaacatcttgatttctatgcatcatctgccttagttttccttgattcagtatctgttgtgtgcttagagatctaccagaaggattctatagaacaatgaacaactcagctttaattcaggcaacattcatccactggacacatatttgctgaatatccattatggacaaggcactgtgcttatcaatgggaatataatatttctccccaaagacataattcctgccctcacagagattccagtctagaggcagaaacagacaattccacaggctgctataaaattttaagtttatgacattgggcacaccgagaaagggcaccttttaattcaccacattttggtctatccttccaaatcatcaagacggtttgccgctgtctcgggtaatcccttgattttgctatttcccagctgttcaccatttctcagccacatgctgtctgaaaatctgatgaccatgataaaaaagtaggtgttgtagtcttcagaatactcctatgaggtaggtactactattatccacattttatagatggagagacagaggctcagagaggggaattcacttggctatcgaagaggcagacaaaggagcaagtatttagattaatgtttgtagtattccaaagcctgtgctcttagccattaaactgtttcatcttgagcaagttattttctcagggattccatttctacatgtatgaaaataaatatgtaaaacttgaaagcctttaaggcttaacattctacaattaatgtgtagtgacagctgagagatgaagggtggggacatgcattctgtagaatttaatacttgctctgttgtttttttccacctcagtgttcatcactcctactcctccattgccattttctggccacttccaggttctgacaattcttctagctgcgtaatccatcaaactatttgcttctgtaaattttgttccttctgatttcctacagctttccctgccatctcccccaccacacatttacttgtcttatgtgcacatatgactcactaaagatgagccaaagtcttgtacataggtctgaaaatcaactgaatgtaaatgaaataagagatataagttctgaatgtatatgaactgatttgcagtccaagtgaaaaacaagtaggggcttctgcactacggtgaagtgggaacaatcaggatgcattaatagaagtttgagtgtttcagagaatggtggtaaaattccacttttctctggtcaaaatatactgaagggatggtgctaagttctgaataccgaaacttaacggaaataaaatcaaatttcactgaagaaagactggcaaatagagggtaaggatctcaaaaacgttctatacatatcaaaatgcaaaatttttttaaagaattaatggtactaatatggtgctacaagtcagaaagtttattgcgtctacagagcactaactggaaggaggcacaaggaaaccatatgaggtgctggaaatattctatgattttatctgtgtagattcatatggaatcttgttacatgtccttatcacaaaaaaattatagtgagaagacacttttagaggtgatggctacgtttatggcattccttatggtgatgatttcatgggtatttacttatcttcaaactcatcgagacatatatattttaaaaagtgtaaaatgtatacaatttttaaagggtaaaaagttctaaaactaaaaatttattaagttgcacagttaaggtatgccttctttattataattatgccaaacttcaatacagctaaagacggtgatggcatgtgagaagtgtttgagaaacagacgccaacatatcctggaatgtgtaaactgggacaacttttctggagggcactttagcaatagatagtaaccaccttaatcagggtcttggaccatgctttgctaatgactatggtggcaacagtgtctcattaattcaatttaattgggtgaaaagtaaatgctagaatataagacacttgtatatttacagggaatgagcatatgaatattatccaagacattcaggaaattccaataaaactcatacagtcttccttgtcatatgattctaattagcaaatactctttggggggcatttttattttgaaatggatccacagtcataaatgtcagtaggttctctgaagtagctcaatctttctgtattcacatttgaattcttcctttatttttaaaactttatcgttgctcataagttaaaagtagtctttactggataaagaaaatgtggtacacacacaccatggaatactatgaagccataaaaaggaatgagttcatgtcctttgtagggacatggataaaactggaaaccatcatcctcaacaaactaacacaggaacagaaaaccaaacaccacatgttctcactcataagtgggagctgaacaatgagaacacatggacacagggaggggaacatcacacattggggcctgttgggggttggggagaaaggggatggagagcattagcacaaatacctgaagcatgcggggcttaaaagctagatgatgggttgataggtgcagcaaaccaccatggcacatgtatacctgtgcaacaaacctgcatgttcagcacatgtatccccaaacttagagtaaaaggaaaaaaaaattaaaaaaaataaaagcagtctttaatttaattcaaataatccagattacaaaggataagatcctcttccaaggtctttagatgctcctttttttcctcctgtaatatatgtaatagtaattctaaggtttggccatacacagaaacctttgaccagtcaggggtgcaaggtgctgagtgggtgtggagcatctgcaatgctcggctcttaccatctgctatgaagtgctcgggcacatgcagagtcaccttcacagtgagtggacaagacatctggctgccacacaccatggccaggatgcaggaactcacagcaatcagtgtcagggctgtcttgttcactgggcttttcagcaaacctggtaacaagaacatacacaaagacacaaaattccatgaggtgaggaaatgggattggcatcaagtttgggaattctattattttccagttgggaatctgaaaaaagaaaagaaaagaaaaaagacatgttttctaacctttgtgcctgctatgacacctcagtgggccttctttgggccttgatttaacactccgcaaaatgggcttcttatgattcctttgggtaagcataaaagaaacaggctttctgaaactcatggcaattttcactcctcccttcccaattcggttggtcattcttgataacaattagatgatattaagccctccattctccttagaggcaagtgagaagataccatgctgttaaattcagtagagtctagtgaaataagcatgggctttggagttagatcattctggattcaaatttgggctttggccctcattggctctgtgatctccattttccaaacctcagtttctttctttctttttcttttttgtttgaggcggagtctcgctttgtcgcccaggctagagtgcagtggcacaatctcggctcactgtaacctccgccacacgggttcaagtgattctcccacttcagcctcctgagtagctgggattacaggcacccaccaccaagcccagctaatttttgtatttttagtagagacgggttttcaccatgttggccaggctggtctggaactcctgaccacaggtgatccacccgcctcagcctcccaaagtgctgggattacaggcataagccaccacttcagtttctttatatataacacgaagataataaatatctcacagggttcttgtgacaattacacagcatgatttgtatatcatgcctgtcatttagaagagtttcacggttagaagctgatcagttcaaatgaatttcacaagcgtttactgagcagctactatgtgagacacatacagagcagaagaataatctttcctcttcaggattttataggctagggggaaaagtcaagcttatccatagctaattagattctaacacaaattgtgttacgacctagaagagagggcagagagtacggggggtggttttgcctctgaaaattaaagacaattttatggatataatacgaaaagtagattggatctgcacagctagacgacactgggccaacaaagaaattctatggaggctgtcttgagtccccgtttgtttctcattctttaggctttgttcttcaaggttttgcttaccagttttagagcaatgcctccacaatttttttttttactgctaggctcttcttttaagcaaaccttgtctctcatctcctggatatctttctgtggctatccaattagaatgtcaaatatattaataacacgttcaaaacagggtacattatcttctccttaaagcctccccctcctgagatcctcagcttattgaaagcactgccatttagactggccagaaactgagatgtcacctttgagtttctgtcttcctcctttacagcatctgaagagttgtgtagtgctatttattctatgtcctcagcattttcacctcttcccttcatctcttctattgtatgtttgcttgtgggataagggaggtgcacgcatatctgttcactgcactccctgctgaaacctctcaagctgttttacagcatctggttgcaggatgtgatccatattcattagactggcatccaaggcctttcatgaagactcccaacactcatacctcctgtgctctggcctaaagactagcagggctgaattactgcagtgctcctaccattaacactcttcatcatgttaacattagtgcaggtgtttttccttttggatagaaatccacttgtttccttgtcaccccatcactctttgagactcaccatatataaagatttcatatgctcttggtagataaactacccatattcattgtgtttcccctcataccttattccaaacactagagtctagtaaatagacagccaactccttgaaggcaagcagcgtcttttgcttaccattatgtcccagtaaatagcacagtgactggctcattgcagaatctcagtaagtgcatgatgactcccataaatgacagtaacaatattaaaaaccaacataacatagatgctgaccaaccaaaaagcatgctagccaacatccaacactggccatacaacagaacatcggctattattctgttgtaacattggattacaacagaacaagaaccgttacaacagcccgttggggtattgcctgtatggaaatctatttttcttaataaacagtgacctgcttgaaggagaagatcccaccttcatcatctttgtgtttcttatgccaaaatcaccacctggaacccagaagttacttaatttaagaacaagacccttgtcttttttctcagtcctaggacaatgcatggcttatggtaggaactatacatgagattgtggttattgtagttttagaataaatgttaaatagaagagtaaattaaattacataaaaaggtgattccagtgtccaaagatggggaatctctaaaacctaaaataactacagagaaaaatgaacatgattatctcttattcgagtgctgcaagaagctgtttcatacatatttataatatttataaatataaatagataaaatatgtatagtataaatcttttagcaactaaatagcataaacaatctaacatcaacgttatctactaaaaagaatatggaccaggggttggcaccttgcattgacctcaccttaaaacgtcaacctattaccccaccctaatcatttagcaaaacccctacaataacacttaacagcagcactggagttttttgttgttgttgttttttgttttgcttgtttgcttgttttgagatggagtctccctttgttgcccaggctggagtgtggtggcgcaatctcagctcattgcaatttccgcctcctgggttcaagtgattctcctgcctcagcctcccaagtagctagggttataggcacacaccaccacacccagctaatttttgtatttttagtagagacagtgtttcaccatgttggccaggctggtcttgaactcctgacctcaggtgatccaccgacctcagcctcccaaactgctgggattacaggcacgaaccaccatgcctggccagcattgagttttttatctagattttatggagtctattctgggggaaaaatatgtaatgataagtctagcatgaataaatgcttgggaagatgagacaggtccagaggacaagatgtgaaaggtagtgagaggcccctggcattgggaaatggacactctggacagtgagtcatggataatagcaccctgtggatcccttagaaggcatatctcattcctggcccacacagcagcaaccagcctatgtggccaagatctttctttcactaattaacaaactaccagaaatacactaccccggctccacagggctaatttttggtctggggaaagaaggctgaggggcacaggtagaatggctcatactctctccctgggccctgctggactaaattgtgtctcctatgtcatttaaaacatcacagtaacccacggcctttaagagtcaacatgatggctgggcacagtggctcacgcctataatcccagcactttgggagacaaggcaggcagatcacctgagatcaggagttcaagaccagcctggccaacacggcaaaaccccgtctctactaaaaatacaaaaatgagccgggcatggtggcaggtgcctgtagtcccagctactccagaggctgaggcacgagaatcgcttgaacccaggaggtggaggttgcaatgagctgagatcgcaccattgcactccagcttgggccacagagcaagactctgtctcaaaaaaaaaaaaaaaagaaaagaaaagaaaaaagaaaaaacaaagagtcaacatgggaagtgaattcacattagtttattggctgttagttttctcacctagaaaatagtaacacaacttagccatcaggggtgttgtaagaacaaaatgggtcaatatgtgtctaatgccaagcaaagatttggcacatagtaggcccttggtaaataatttccaaaagaaatagtggtgtttgtctcatcattgatgacagaaactaggaatcatctatttgtccaacacattctcagaacatattaggaactcaattattcttatagaagcagaagacaaaaagagtaaaaagtgtagagaaggacataagaaggagaaagtgggagttggggtgagaatgaacagcattgtggggccccatttactcggcgaatgcctgaatcaccacagttgtttccgaagtccaggaggatgaaagcatgcaggtcaagccttcactaagccagatgcccatggagcagcagaggggtgtggggagttgccatggcaaccggacctggcagaaacttcacagtgggactcaaatcaaggtaacttcctaagagttcctggctcagggaggtgagcatagcatttagtaagtaagggttgtagacagccctgaggtggaaactatctctcccataatactcacaccctcccaaagcaggcttcttactgcactgctgttgtaagatgcagagacagaaaagggaacctccacttgctgagtgattactatgatccaggcactgtgcctagcacttatccttctttccatccatccattcatttacgaatccagccgatttttattgaacatcaagtcttttgaggcacactggtctgggcatggggaaaataatactaaacaaaacagcgaaagcccttgaagcttacatgttagtggcaaagaattatctcattgaatcctctcagctaagtgtctccatcatttccattttacagagagtagaagtgtagagcaattaaatgacttgtgtaaggatcacccaattttgtatgttacagagattggatgagaactagtcctgttccagcctttcccctgtatcactacaacttcccactttatcatggaataaggtcccaggataccctcatgtagaaagtgtggcctttggggtcaggcatatctatgttcaaatcctggcttacccacaaaatctctgtgtgacactagccaactgatccataagtctaataagaaaaaaatatttccatctgaaaaatgggaacagtggtcttttttcagagctgatgtgaggacagaataagatatcccatgtaattagcaaaaaaaaaaaaaaaaagagctaaataaattaaatgatagctgcagatcatattgcctgagtatttttttttttccagaaggctgaggtcacagttctccctgattcacatccccatttgcagttccttccccattacttgcaggggaataagctgtgctgtaggaatagcattccacccgggcatattgattgctgggactggagaaaattaataatctaattttccttccattttccctccctcttacacctcagctcctctcatggcagcagagaatggcataaaatgcattgcttaagaaattcgaccggaaataactcagtgttgttgatccacacattgcctataatttggggtttgattgattcttgctttggaaatgccaggttgagaggagaaaatgaaatttaagttaaatttggaattgaatcaatcacattttataatgaaaaaatagatctaaccccatcagacccttgtgtgtggaaaacttaaagctggtacactcccattgacttcctcctgagatccccaaagcatgagagaccaggtcctaggctgagaagtaatttatttcttagagtggcaaatggtgttgtggtgggggaaagggattctagaaactggagacattagggtgaagaagcccagcaggtagaaaggccacttaggatggggaaagaggctgggcttttgtatgtatgtatgtatgtatgtatgtacgtacgtacgtatgtatgtatgtatgtatgtatgtatgtatgtagtctcactctgtcacccaggctggagtgcagtggtgtgatcttggctcactgcaacctctgcctcccaggttcaagcaattctcctgtctcagcctcccaagtggctgggactataggcaaacgccaccacacctggctaatttttgtatttttagtagaggcagggtttcaccatgttggccaggctagtcttgaactcctgacctcaggtgatctgcctgcctcagcctcccaatgtgctaggattataggcatgagccaccgtgcccggactgagctttggttttagatgtggatatctaaatccaaagtcttccatttgatacctgcctaagttctggcaagtgatgtaagctctcagagcttcagttttcctaatctaaaaaagggtagtgataatccctaactgataaagaagctgtgtgttttaaataggagatcataattacagcactaagcaccatgtctgacatatacttagggctctgtaagctctcaatatatttccttccatctcatttcctttaaacctccctttctaatacttggcacctacatgggcatcagcaggatatgtgatactgttgctcatgctgaaatcctaactttcacacttagctgctggcccccgtggacaagtcatgtcacatctgagactcaatgcctttaattgggaattagttcatccaataaatagctatttaaggtgcaagtactgtatgccagacctcatattttatgctctcctatttccagtgcctatagcatgcctgaatatagtaggtgctcaataaacatctattgaatgaatgaatgagtgaatgcttaaatgttgtttccctttctaccaacagatgtcagtattggaatgctgctattggtatttttttctagcaaactgattcactcacttttcctggcaaggtttggttcctgcctggtcagaaatcatacaaaaacacccttgcagaggccgccaatctgcctgcatatcagggtgaccactgtagattgctgagtgcctcattaacctcactgagtgccccatgggattcccacagcacctgagctctggtgtctctgcttctctgccatatttctggaaactgaaattgggacacgtcatctgacaagtgcaagtgtcatactggaggcagaaagaaagaatattttaaactggggctttctcagaaactgtagggtatatggccccatatcctcagcgtgtctcttatatcaggggtttccatgcactgctttagtgtgatgtctcaatatgggacatattttcctttatcttgcacaccttggtccttgtctctccccatttctccctctctatctttgtcatgaactaatctcttgtgctgtctgactacggcactctcaaatctatggtatcctttaaatgatatgttatttccccaatatcttatcatctatagatttgtccttaataagatctaggcaagtgttcatccactcttattttcatacttccagagaaagaaaactcaacccctactaagcatcagttctattctcagatagtttaatgtctaaacagcctttgaatctcactctatgagtgaacttctgctgtccaaattaaataggatatatttaatatctccttcccagggcagctattttgttaaaggtggaaattaggttgccttgagctttctttcttcaaaccaaacactaataactttattttgtttctctaaagtcatattttgagtccttttattgtactttgtatagatttgttttgcttaagattactttcttagtaaaggatgccataataataattgttattattattatcatcatcatcactaccactatcactagtaacatagccactaacttaggtgccagacaatagaactaaatttttgcatgcagtatctcatctaatctttacagaaacttcatgatattgtttctactatcactcacatttttcgctatgaggaaactgaggccatcacttgccaaagaacatgcagcttaaaggtaatagggctgaaatgaaaaaccatttgatgtcagggtccaagctcttaaccatcatccttcacaatatctctatcaacctgctagatgtagcctgggcagagcagaagcaacaaatttaactgctgagctgctatccgactttagcttgccctgtggacctgtgatgactctaggtgaatttgtggtggcctcattgtcccacctgataccgaccacatgtcttcaagagaacctctccccatcacaaggacaaagtttaaaatgatggaagaaaatgagaagggctgtcgctcctcctttctcagccccagaaaatactatgggcctgaagcagctcactgtgctacttggagccaaatgattattgacaaagccactggggaacacctttggctagctctggtcctgggacaaagaccgtttctatagtgcaggcctagattgtggctgcctggtgaagttaaagccactggcagctgacatggaatggggctacaaacggctggctatttgaatttctctgtggcaactgcaggtagctgggcttgcaagtgcaaaggtcactacaaggtgttgacaatggtgttagagatgaagatgatagagatggtaccgtattattttagcttttattaggttacagattattctcaaatatctcattacctcttcaaaatcctatgtagttggcattgctgttatccccaatagacaaatgagaagtgacagtcttaaaggtgaactcatgttcaaacaacagaagaataatgggcctataagccatgtctcctgacacacagctgagtgatcttttcatgtcactatgttgctagtgtgcagcctaagtcccactagctggatatgaaaacagaaatagaatctgtgcgctctgattcttcatccattgctttttttttttttttttgagacggagtcttgctctgttgccctggctggagtggagtgcaatggtgcaatctcagcacactgcaacctctacctcccaggctcaagtgattctcctccctcagcctcctgagtagctgggattataggcatgcgccactgtgcacagttaatttttatatttttagtagaggcagagtttcaccatgttgcacaggatggttattgctcttataaatgtatccaaatgcctcaaagagctagtgtagtatttcccacaaaaccagatgtatcttgaaaagaaaatatttctatgttcacaaaattttgagacatgctatattctgcatgtccctcttaaagcacccaagtatatatctggtattaaaatccctaaaagtctttgcattacattctgtttaacaggattcagccgaatgtttccctaaagtattaagacattgcagaaccaccattctgtggaacaaggtacggaaaaaacgatctagtttaataatttatacaaaggttgtaaataatattagcagagcccaataatcaactggtgcccttatgccaggcactgtgttaaagattgtatgtacattatcctatttaaacttctcaactaccttgtaaggcaggggttacccttcatttacaaataggaaaaccagatttaactggtcactgggaagaggaagaggaaggttttcatggtcagtctggtctgaaaccaatgtctgtatccttcttcttcccaagtgttagaagaaaatagaattttaaagtcacagagaatacatgcaagaatgaaaaaggtaggcacaacagatcagttcaggaggctaaagactattcaacgtatatttagcaggctgacgaaatgcattagtggaaggaaaaagatgctgtactcaatagattaaattgcagtgtgtagatgagaaatagtagagaagataattcaaagatctaaagctctagaatggctcagaaataaatgagaaagaaggagaaaggaaaggtggtggggggtttctgattcataggtgactatcaatcgactggtgctgacttacccaaaatgttaatttttaagatactgttgtctgatacccatattagccctgttagtctacaggctgtttagatgcaccaccacattcagcccacaccaccgatgaattggagggtggcaaagaagagctaaggccaagcagtgagtgctgaggaacagagcaaaagagcagccacagtttccatggctaccaaggacgatcaggaccagtcacctcccatttccatgaaaggttcatttctagctcctttgaaagtccctgttccattatcttggaagatgtcagtggactttggcccacactttgtgaaaataggagcaggagaataacattgattgtgtatttagtatttactaggcctcctgtgatggcctagtaaatactgaatacacaaccaacgttattcccctactcctgcttcctcccctgctcccagcttccatgacaatgttcctttacctacagaacttcctttatcccaaaagcccaccgtaagcaccaggcaaagctgtccttacttgacattgggggaaatggaagatcaaagggtttaattgactagtaaggaacagagctagaatatgaacagagctagaatatgaaccgagacctattgatactcaaagttctttaaaagcttcctcagctgatcctgaccctgtgaatgtatggtgtctaatggtggtcacactgcttctaaaaatagggggcattttcacatctctgtgctccctcctcctcacctctttttcctgacagtgacactgtgtcatattcctaagaaacaatagaaatgaggcttttcctgatggcccacaaaccccctactgcagttagatttgcctgtctctttccttgtgacaggtcatatgcattcccctcccccatatgttgtcctttctacttttccaacatatctaagcagaccaactttcaagatcaaagagaactcccatctcatagaagtctgccttcaccattgcaactcacaagaacccattatttctcttaaccctatctcatatattttctgttctaatttgagccacaagacctcagaatggcaaggaactaaaagagatttaactacaacaagtcacacaatgcattgttgtgtgactgactccctctataatcattcagcctgcatttgagtgtcacctaaacttggagcttattaactaaaaaaaaaatgatgatgataaccctttctctttttttgagcacttactatgccggatacattgtgctaaatattttacagatattattttatttgattaatcataaaagcttgctagttcctagttttgcaaatcaaaaaaattgactctaactcagagttagaaagctattgagaggcaaaccaggattcaaatccagatctagatatcagagctcctaacagtattactatgtagtctctcttccctggtagcaatcagcataagaactacatcaatgccaaaagaaaatctattcctacaactataaccagctgaacatattcctgtcctcaagagttctaaaaactggcccccaccccttctctccaaggtacccctttggttctaaaaatggaaaatatgttgcccatcattcttttatttcaaagacagattctgtcatttgactctcacatgaggaaaatagacacagagccaggaaaaacggagctggaagaaccccttttgattagttggcctaatccaccatgctgaaggttaggaagagggcaggaggacagccacgttcacagtcagattgcccagagccagtcctgggttccatctaccccagcttccatgacaatgttcaccatttggggtagttgttgctgtttttgttgtttcctaccttaaccaatacctcctggaaaaaagaggtattggtataaaaataaaccatacccaaacattcccacaacatgaccttaataagctggtgcacagtagattatggcagaggaaagaaaattgactttagaattagagaaacttaggttcaaatctcagctctgtcatgctttggttgaccttcagtaagtcccattttcttcatctgtaaaatgggaataacatctactccacagcatcattagaaagattaaatagtggctgggcatggtggctcatgcctgtaatcccagcactttgggaggctgaggtgggcggatcatgaggtcaggagattgagaccgtcctggctaacgtggtgaaaccccgtctttactaaaaatacaaaaaattagccaggcgtggtggtgggcacctgtagtcccagcctctcaggagcctgaggcaggagaatggtgtgaacccaggaggcggagcttgcagtgagctatcacaccactgcactccagcctgggcgagagagagactccatcttaaaaaaaaaaaaaaaaagaaagaaagattaaataattaaatagcatgacatgcactgcatagcagaagctcagtgaatagtaaatttcatcgtcatcatcatcaacaaatttaagaccaatacatataaattctgttgtttgcactcaagagaccacttataaaaactcaggatgggtcagaaataggagacagaccatgtagactggaggatagtgagtttacagtaaggaaaggtccaaacacatgcagagcacctactatatgcgaagcctctgctgggtttttgcacctgttatttacattgtttctcatagcaacctttaggtcttcattttataaatcagaaaaccagctcagggaagagaagtgctttgctcaaggtcatacgcctagtaagctgtagagctggtcatgcgattcaaaactgtgtgatgttctaaacagaatatagacaggtggaccatgttccaaagagaataaccaggattggactggatatcatgccaggagaggacaccagatgaaggatttggggattttagctttgaagcaagaaaggctcagtcagagaggcctcttgatagggttgtcttcaaagacatccaaatatagaaagagaaaaaggaaacacatattctatatgagaagctattgtgaaccaagcctcaaaacctaggcacttgatgtgcactgtttcacttgctccttaaaacaatcctctgtgtaggtagtggattgtgcatggtgactcaagcctgcaatcccagtgctttgtgaggccgaggcaggaagattgttagaggtcaggagtttgagactagcctgggcaacatagcaagaccccatctctacataaaacttaaaaactagctggatgtggttgtgcatacctgcagtcccaggtactcaagaggctgaggtaggaagatcgcttgagcccaggagtttgaggctgcagtacgctatgatcgtgccactgtactccagcctgggtgatagagagagaccctgtctcttgaaaaaaaaactaatgatcttctgggggtaaatagcattatgctcattttagaaatgagaaaaatgaagcctggggagatcagacacttggttcaagttgcacaagccatcaggagcactggattcaagccaggtctgtttcaccccagcaacatcctggctcttctcagttctcactggagtttgttgaccatcaagggcccttgcaggtttaagcaactctaaggaggtctggcctaaggaagcgggacccaaggttcttgctcagcacccaaaccctcattctggtaaagaaaagaattggggccttgcaggccaaagaagactctgtcctttcctggatgtagaggttcagctgcaaaccacctggagattttattagaataaacacacccatctccagatccttaaatcaaggggtcttttgtttttattttttatttttgctttctgatctattgcctactcttcagaccactaacattttagcaaaaccatgtatgcattgtgtttaaatagtcatctggagataaatagctttgcctttagtgggggaatataagagaggataaaaaaagaaaaaaaaaaaacaaaagaggagaaaatgttctgtgaagcctttttgctcaaacacatttccacatggaaatctctacccatttcaggctgacactctggtctaaacctttcaagcctgctggtttaaatatgtcacttccaaaagaacaatggcagtcttagcccaagggccattctagacccactttctgtcttggtttttagtgtcaaggaagtgcctgaaggctgtgctaagaggactatctattctgggagtctgaagcccaaacttgaatataggctctgccattactcactgtgccacctggagcaaatcccttcccctggctggacttctgtcccctgttcatcataggaagaaatccattcattcaacaaatatatattaaggacccactctgctgtgagctagggatacagagctcagagccattaaatgtttcaatgtccagtgaggtagtgggccaataaacagaggtagcagagatcagtgcagagcagcaaatccttaatccagattcaggggtcatagaatgattaccaagagctgaagcttgtaatgtgtgtaagagttagctgatgggaaaaatggggaatgtgcagttcagcagaaggaaacagcagggcactgtacatagactggagtggtgggaatttcaggtacatgctgtgcagtgtgggcagaagaagccagagagataggcagggaacagctcataaaatgtcgtagttcattgcaaggaaagtggactttctcctagatcagtggtccccaacctttttggcaccagggatcagtttcatggaacacaatttttccatggactgcaggaggtgggggagtatgatttcagaatgaaactgttccacctcagatcaagtattagttagattgtcataaggagcacaacctagaccccttgcatgcacaggttacaatagggttggtgctcctatgagaatctaacgctgcagctgatctgaaaagaggcggagcttaggctgtattgctcacttgcccaccgctcaccttctgctatgtggccaggttcctaacaggctgctgaccagtaccagtctgcagcctgggggacccctgtcctagatgatatctccagtcctttcaggccagctctgccagcactgtgcaaacctgaaacacatcttcattcatttactttgacaacaaaaatgtaagtaagtacctaaaagtgccagacattgtgttgggtgctggggatatagcaggtacttcataatcccaaagcgtgaaccattaggtatatcaagatctgaagactgggccaggtgtagaggctcatgcctgtaatcccaacactttgggaggccgaggtgagaggaccacttgagcccaggaatttgagatcaacctgagcaacatagtaacacacatattttatttaacatgcagaatatatttagtctctatatttaaaaaacataaaaaaagatctgaagacctatgaaggatgagatctacaatatctacctccagaatggaggacaaagaaagaaatctcgttgagcaaaggcaatctataagaatatcagaggatatttacacgagaggaggctgaagaacatcctggctagaattagagaacatgaaacctggtgataaatcagtcttcgagtacatggacgtgaacgagcacatgtcacctgaaatgaaagaaggattagatttggagaaaaggaaagagggcaaggggactgagggaggtagtttccaaattgttcccaatggtctttgcttcctggtatccttgtccttgtgtaaaccctagtgacttgcatatatccaatgcaagaaggtaaatgttatgcaatgccacttccaaggttaggttatgaaagactgacttccatttagctcacactctctttggctctttttactttcttgctctggtgaagccaaatgccatgttgagagtggccctatggcccacatgagaagagctgaggatggcctctggctcacggctctcaaggaacaaaatcctgacaacaaccatgtaagtaagctgggaacagatccctccccagttgaagcttgaggtgattgcagctctggttgacaacttcactgcagtctccttcgaagccctgagctgggggactgatgatattgtgcctgatccctgccccacagaaactgttagataatgaatgtttgttgttttaaattccaatttgagggtgatttcttacacagcaatagataactactaccagtacctacttaaatggatagctgaaagaggctgatgagcctccattcctagcaggatatcagaaaccttcaagtttagaagagacttccattcatctagaaaacatttcccacacacatggtatgtgccagaccctgggcaactcatagaacttgcaaaagagccaggcacagctctgccttgaaggagccacagagagacaagtgagaaggtcaggtggagacatcataattacactgtgtcaggatacatgcttggctattttactgaagacttcacaagcttattaagagctgagagaaaagagccactgaagtttgcttaatgaaatccaggtcagcttcacacaggaggcagcaggcaagctgattccttgttatctttaccaaggcacctctccctggaagcccctatgttcacacatcaaccctggaagttggtgaaatgaaaggcttgtgagctctacaatcagacaaataaagtttgaaactcagctcaataatttcttaacactgtgaatttaggaagtcaataagaaggaacagctaagaacatgattagagtcgcacagggctaagagtaagcaacagagctatccattactagttgagaatgctgatacaaggaatcacgtctttcaaagcctcatatccccatatgtaaaacagaactaataaaatattgacttcacaagattacttaagttaaagcaagaagtttttaacatagtggatgataataagaaaggcttgataattatcagctctttttgttggaacagttacttaatttctttatgcatgtaaagccttttagtatattgcttaatatagagttctcagtgactgttagttgctatgattattaacagcagagaccatagacccagtgaattatcatggttcctcctagcctaagggctggccagcaatgatacatctaagttatatatccctgtgcatttataaaaatgcttcctaccccacccccagggactctcagctccttgcgctgaaatggaaggccacagattatttctgcagcaggagctgtgccaaggcatcattaaggtagagatgacagagacagggtagtggtggttccctaagtaactataactcaggtgctacacacacctggcgcttcctgcatatgctgttaaatttatgggacagcaataatagtaacaacattagcacaaatttatttgtaaaatgcccacacctgaacagcttgaagagctaaaatagaaaccctactaaattttatagaaatctatgtatatatgtgaagatgtgaagatgtgtgtaagtgtataagaattgagatcaggatgtagctgtgcttagagtagaagtaacagcagccctgggaatcataactatgattttcttcttccatttcgatcatcgactagaccagtattattagccatgttgctgccttcttggttttccagtagtcagcagctcgaggcaagaaaaagtgccattgcaaaagccagcaggattcaaattcccaaatttatcagtctctggttacacgaacttaggctggtcatttctgtttttgtagtatcaggttcctccaaagataaaataggcataactataacttagtcctactccatgtctagtgtggaagagaggcactccctcccacctctctttcttcataaagggcaaaacatatgaaagtatgttgtttttatagtctaatttcccagttgattatttgtaaagtttatttagcaaagtattataaccaggtagagagggatacagaacttgcccccctgccatgttactccacgttcctcaggggcatggacccttattattttctctaacaccaaacctggtattgagtatcagctaaattaatatttgataaaagaataaatggataaatgaatgaatggacagaggctttaaccaattccttatttgagaaaaagggaacaggcttcatgggatcatcctaaggcaggaaaataaaatccagtcattaccttctcagtgcagagaacaagatgggcaagagtttcagctgaagtattcccttgtttcacaataaaaataatgacagctaccatatttaagcacttactctgccctgagccctggattaagtcctttgcagggaatattatcatttcatatttacatcaaacctatggagttatagttactatgcccattttacagaggagaaacttaagttaatataaatgaaatttgtgtctgttatcacacaactaataaaattttaacccaagatatctgaccccaaggtatagcctctgaaactgtatctatactgcctcctaggtgactgcagagatgcatctttctgagcattggagacttccagatgtaacagaaattgagccagatactgctaggcacagggagctgaaacagaaacagacatggacgccatcctcatgaagtttccagtctggtggggatgggagatcagacatgaaaatgctagtgtacagaagaatagggggacatgagtgagtataccagaaagacctttttcagaaaggggcatttaagccctgtcctggtgggagaaaggatattccaatgtaaaatgcactgaaaaaggcagtgagtgacatgagatggggctggagaggtaagcaaaggcatgcaaaacgttgaaggccagttaatgagtttgatcttaattatgaaagagcagagaaatcagtgaaggtggcataatgaggcaacgtgttataatgcccggtctatctgctaagggagaagggtatcctgccagagtgatggtaaggaacaaggagtcatggcttgaatagtggtgacactggggatggagagagtcatcaaatgcagagtacagttggggatggaattgctggacttgtgatgaatcagatcttctaggaagtagaaaagggagaggataggtggtgtcttgacatctgtatccaaactttactcccagacagaatgtcttcaacaggtcatcttactgccatggggaagtacagataaaaacacagaataggccaggcgtggtggctcatgcctgtaatcccagcactttgggaggccaaggtgggcgaatcacgaggtcaggagttcgagagcagcctgaccaacatggtgaaaccccatctctactaaaaatacaaaaaattagctgggcatggtgatgcacgcctgtaatcccagctactaagtaggctgaggcaggataattgcttgaacctgggaggtggaggttgcagtgagccgagatcatgccactgcactccagcttgggtgacaaagagagattatgtttttttattattactattaaaaaaacaaacaaacaaaaaccccaccaccaccaccaacaaaaaaacacagactaacctagtaagataattttgtgtccttcttaattcagggctgaagacagtatttcccattcttcactccagttttgattagtcattatcattcaattgtttacttattctctaatcaacaaatacttataaagtttccatatttcctgtatgggccaaactgggcattggagatacagggaaagacaagaccgcaattcctaagtgatgcatcctggtttatctttgggatgggaacagtggtttcctagaactgactccagctggctcacaagatccaattgttaaatatttagggatgttgcatggcagttgttaaatgcagtggcttgaaattagacgtgataggtcaggcgtggtggctcatgcctgtaatcccagcactttgcgaggccaaggcgagcagatggcttgaggacagaagtttgagaccagcctggctaacatggtgaaaccccatctctactaaaaatacaaaaattagccaggcatggtggtgtgcacttgcagttccagctacctgggaggctgaggcacaagaattgcttgaacctgggaggtggagtttacagtgggccaagattgtgccactgcactccaacctgggcaaaagagcaagactctgtcaaaaaagaaaaaagaaagaaagaaagaaagaaagagagaaagaaagaaagaaagaaagaaagaaagaaagaaagaaagaaagaaagaaagaaagaaagaaagaaggaaaggaaggaaggaaggaagagagagagagaaagaaagaaagaaaggaaggaaggaaggaaggaaggaaggaatgaaagaaagaaagaaagaaagaaaggaaggaaggaaggaaggaaggaaagaaagaaagaaagaaaaagaaagaaagagggagggagggaaagaaggcaggaaggaaggaaggaaggaagggcgggccaggggcagtggctcacacctgtaatctcagcactttgggaggctgaggtgggcggatcacgaggtcaggagatcgagatcatcctggctaacatggtgaaaccccgtctccactaaaaatacaaaaaaaattagccgggtgtgatggcaggcacctgtagtcccagctactcgggaggctgaggcagaagaatagcatgaacccaggaggtggagcttgcagtgagccaagattgtgccactgcactccagactgggtgacagagcgagagtccgtcaaaaagaaagggaaaagaaaagaaaaaaaagaaagaaaaaataaagtagacacgatagaatttacactaggaaaattggcaaatactacaaatcaggttttttgttttgtttttcagagtcagtttaccagcataccactgggttggaatcatggggctgaaagcctaatggtttgtcttccaagttcaaggaaggcagaaatacaaacagaaagttaggtcacagttacaaactatacaccagtcttttatttatttatttatttatttatttatttatttatttatttattttaaagaatgccaagaattgcaggggcaggttgtagactttggagtcagacagatctgggtttgtatcctgtggccagcactcaatgatgatccaaattgggcaattcactttaccattcttatcctaatttttttgcctttgacatggagataatgtttacaaatcatgatgtaagtgctttgcacagtgcctattattaatgttgctctttttttcctccattttttttaatggaaagatatgccttcaaaaatctgctttgctgatgtgtagttcagttttattatatcaaacttttacataggctcatcaggaagaggactcctgtctgtttccaggtgctcttttagcacacagataatttagactcatctttaaacgtccagcttaagccctcaacacgtgggagggagtcaaatcctgaagttagtgggaggccataaatcgtgtataacaaatgcacaatatctttgttatacaagttattaatgtcagtctgggctgtggcctgtttacattctctgaacaaggagataaatcatcacccttgaactttcaatgggagactgaagagggagagaaggctctcaattcagttcttcaaagactttctaatcctcatacaaggagagaaggaggaagaaaaggggagagttggaaaaaaatcaagaaaggaagagaggagggaaggaaatacttggaaacctaccatatgccacatagtatagtcatttgttgcccacattattttgtttaaacctcattacaacactgtccatacttctacagatcaagataaggtgctcaaggaaactgagttacctgcccaaggccatatagctggtaagtggtggagctgggatctcacgcaaggtttgaatttgaaggatgggtcttctcctgtaccacacgatgaattatgtacaacgaggggcatgactttatttgaggggccaactccagcaggattggccctaaattgaggcagccaagtgggccggcctgccctcaacactgtaaccatggatttatcaaggtcagccacctcagccaaactacctgatccagtcaccattagaggatcttctcacctcacacaagaatagggccacaactatctctagacagccaccactcacaacacttaggacctaaaaaggagctttttcccccaatagccccttaaccttattgagcaagtgcaactttctgttgctccctggctcagaattccctatgagacatgttaaaaatacagtgctttgggccctgtgtaagacctactgaacaggaatctctgggagtggggtttagaaatctgatttttaaacattttttttcctggaaatgttaactattattcctgcagatggagaatcagagaaaggttttttaaaaaccacagtgataatccatgcattcaatacaatctgcaacaagcccttagccatgcccttgagtgcctatgggtgctgatgccttcagagcaatggtaatggtgtaagtgagtgtgtgtacacactcatgtatgtgtgcacttttctagcatactatatagaaatacagaagacatttctttaaaattaagtgtaaagcacatatttatgtctagtgaaaggaatactgttcatatttcttatatatagcaggttaattaggcttgtagataagactagaaacttattcataaccatatcaatacgcaggaagactaaggatacagaaaactttttaaggggctagccttggctccagactaccacttttactgttgccatacctccaccagagcagagattaggtagaatattgtgtgctagcctcggaagctaaccaacctgttgtattctcttacttcaagtgcattccagattaaggacaactttttctggaacagtcttggaatccaaccacattaatgtagattttcattatatacttactatgtcaggtatagttacagttaaaatatattccatggtaatatgttaactagagcaattcttagacacagtttataattttgtccttcataaggtacatttcttcagggtaaagaaccatttggggctcatctgaacacctggtgatatggtttgactctgtgtccccacccaaatctcacttgaactgtactcccataattcccatgtattacgggagggacccagtgggagataattgaatcacgggggtgatttctcccatgttgtcttcatgctagtgaataaatctcatgagatctgatggtttgataaggggaaacccatttcgcttggctctcattctctctcttgcctgctgcaatataagacgtgcctttcaccttccaccatgactgtgaggcctccccagccacatggaactgtaagtccaattaaaccctttttcctgtataaattaccaagtctagggtatatctttatcagcagtgtgaaaacagactaatacacctggttatctaggacagtattgcaatgcttttagtccactagaaggtaaatcaacttttgtgggctagcctgggaacactgcccttgagcatatgtttgcttttataagaaagcacagcctatatgccaaatggtcttacaaataaattgctagcaagccagtgggctcctaggttggggtcctaagggttgtagcaaaaccttactggggtgttgtgagccacaggaccacaagtgctagatgaaagcagagctagccgagagctataaatagtgtgccaagtgaccctaacaagctctcctatccactggggctgctccaacagctttctcttttggatacatgaaagcagctgaaagattgttttcccgagagctttttggctgccctgagcatgtcaagggactttgctgtttctaattatctccctttatgttctggccgagacttgttaatacaataaaccggtgtttccaggacgcgctcacaacgcagaaacatctcaaggtgttttacaagcagaagatcatgttaaatcaaatcaaataccaattaaagattaacagtggtgttagagagctgttatcacggtccagccagggccgctgggatggccagtgcttcctccaagctgctgcagtccagcttccagccagattgctattttggtatctactgggtgtcacagtctttgcctcagctccaggattccagaatatcaacactggaaaaatgttaaaggtcttcgcagatgatccctgttgtatcaaatggggaaactgggatttggagagaagggatgacccaacatcacccaatgttaagaatccaaacttctcaacatagaatgcctttggcagcaacgtaaatggaactggaggccattatcctaaatgaaataacgcagaaatagaaagtcaaatacttcctcttctcacttataagtgggagctaaacaatgtgtacccatggacatatagagtggaataatagacattggagactccaaaaagtaggagggtcggggggaagggatgagaaattacatgttgggtacaatgcacatgatccaggtgatgcatacactaaaagcttaagctttaccacaatctatccatgtcataaaactgtacatgtaacccctagatctatatacttaaaaaaaaaaatccaagatttttgagctactctcaagcacgcctagtcactggccccacctagatgctttcaactgctgtttctctgctgtctgcttgtggtgggttgaattgtggctattacaagacatgtctacctggaacctcagaattgaccttacatggaaaaaagggtctttgcagatgcatttaagttcaggatctctagatgagatcatactctgtttaggataggccctaaagccaatgattggtgtccttataagagaaaaacagaggaggatgtgaggaaaacagggattggagcaatgcacatacaggactaggaacttcgaggattgctgacagctccaggaggctaggaggaagccacggaacagaacagattctccctccgtgcttccagaagaaacccacactggaataccttgattttggaattctggcctcaaaaactgagagagaataactttctgttattttaagccaccaagttttggtaatttgttacagcagccacagaaaactaatatccccctcctggagtgcctttcctcacatcctgcacatggtgagaacttacctttttttcgagactcagtattagtatagcctccagcctgtgtggaagcactcttgactgaacccatgagctggatttgcacaaacctctttgatgttcttaagtgtgtatatctccatcaagttcatttcagcatctgtaactcattttttagttacctgtctctctcccctaccagaatttagagtttgcctggagtgtagaccatctgtgactcagttcagagtactagagccaatcatacatttggtccatacaggtgttgaggaaatgtctgttgaataaacatgagtataaacaagtgacctaatccttgtactcttacttctttgtcaattatagaacccacagccactgcatctctatgcctatctatcaacctttcctttcccctaacttgaagtctattaaagagactcaggttttcaggcccagatgtgaggtggtataatatcaaaaataaaagcaccagctttggggtcaaataggcatatgctctgattctgtcactttcttcgtaagtatcttaatgtctttgaacctcatctttaaaatgtaggtagaagattaaatgagataatgcatgtaatatggtcaattactcctctcagaagtaccatcactcccattttatcttttttttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatacatgtccctacaaaggacatgaactcaacatttcttatggctgcatagtattccatggtgtatatgtgccacattttcttaatccagtctatcattgttggacatttgggttggttccaagtctttgctattgtgaataatgctgcaataaacatacgtgtgcatgtgtctttatactagcatgacttatagtcatttgggtatatacccagtaatgggatggctgggtcaaatggtatttctagttctagatccctgaggaattgccacactgacttccacaatggttgaactagtttacagtaccaccaacagtataaaagtgttcctatttctccacatcctctccagcacctgttgtttcctgactttttaatgattgccattctaactggtgtgagatggttttgatttgcatttctctgatagccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatgttgattcttcctactcatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatgctgagactttgctgaagttgcttatcagcttaaggagattttgggctgagacagtggggttttctagatatacaatcatgtcgtctgcaaacagggacaatttgacttcctcttttcctaattgaagaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttcgcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtcgaaaattctcttttttggttgtgcctctgcctggctttggtatcagaatgatgctggcctcataaaatgcgttagggaggattccctctttttctattgattggaatagtttcagaaggaatggtaccagttcctccttgtacctctggtagaattcggctgtgaatccatctggtcctggactctttttggttggtaaagtattgattattgccacaatttcagctcctgttattggtctattcagagattcaacttcttcctggtttagtcttgggagagtgtatgtgtcgaggaatttatccatttcttctagattttctagtttatttgcgtacaggtgtttgtagtattctctgatggtagtttgtatttctgtgggatcggtggtgatatcccctttatcatttcttattgtgtctatttgattcttctctctttttttctttattagtcttgctagcggtctatcaattttgttgatcctttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcactcaggagcaggttgttcagtttccatgtagttgagcggctttgagtgagattcttaatcctgagttctagtttgattgccctgtggtctgagagatagtttgttataatttctgttcttttacatttgctgaggagagctttacttccaagtatgtgatcaattttggaataggtgtggtgtggtgctgaaaaaaatgtatattctgttgatttggggtggagagttctgtagatgtctattaggtccgcttggtgcagagatgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagaatttagtccatttacacttaaagttaatattgttatgtgtgagtttgatcctgtcattatgatgttagctggtgattttgctcgttagttgatgcagtttcttcctagtctcgatggtctttacattttggcatgattttgcagcggctggtaccggttgttcctttccgtgtttagtgcttccttcaggagctcttttagggcaggtctggtggtgacaaaatctctcagcatttgcttgtctgtaaagtattttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgatggcctgccttgctagattggggaagttctcctggataatatcctgcagagtgttttccaacttggttccattctccccatcactttcaggtacaccaatgagacgtagatttggtcttttcacatagtcccatatttcttggaggctttgctcatttctttttattcttttttctctaaacttcccttctcacttcatttcattcatttcatcttccattgctgacaccctttcttccagttgatcgcatcggctcctgaggcttctgcattcttcacgtagctctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttctgttgctggtgaggagctgcgttcctttggaggaggagaggcgctctgatttttagagcttccagtttttctgttctgtttttttccccatctttgtggttttatctacttttggtgtttgatgatggtgatgtacagatgggtttttggtgtggatgtcctttctgtttgttagttttccttctaatagacaggaccctcagctgcaggtctgttggaataccctgccgtgtgaggtgtcagtgtgcccctgctggggggtgcctcccagttaggctgctcgggggtcaggggtcagggacccacttgaagaggcagtctgcgggttctcagatctccagctgcgtgctgggagaaccactgctcccttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcatggtgcgccgtttcttaagccggtctgaaaagcgcaatactcgggtgggagtgacccgattttccaggtgcgtccgtcacccctttctttgactcggaaagggaactccctgaccccttgcgcttcccaggtgaggcaatgcctagccctgcttcggctcgcgcaccgtgcgcgcacccactggcctgcgcccactgtctggcactccctagtgagatgaacccggtacctcagatggaaatgcagaaatcacccgtcttctgagtcagtcacgctgggagctgagaccggagctgttcctattcggccatcttggctcctcccccactcccattttacagattaagacattgaatccaattgcacaggtagtaagtcacattgcaggacttgaaattcatacacttcaagtccatgctcttaaacactacattatgcagaattatggggcctcctacaagataccccctagtccgtttgctgagtaataaattattctatcgtttccaagaatgaagcctctttggaatagcacacatccttgaatttatcttgtttggtattccagctccttgggaggcctctaaattcatatctaatacagacttctctagtctcagctggtttgagacactgtggatcgtaatgctgagagtatgaaaacaaatgccttctgcccaaaccatcatctttcaattacaaatcactctgtcaatttgcaagtgttttggatgcgaacatcttgcagtctggcactagttagagctgagaagaaattgagagaggatacatggggagaggaagagatgaaaagaagaatgaatcaaggatagaggaaggagaaagacaatggaatcgtcaatttgaacagatgtttagaactcatctaagtcagggccctttgtagcatagttccaggggccctgatctcatggatctatgaattggaatccaaggagtggaatggtggctcctggagttgtgaaatatcatgacacaaagtccaactttatttatttatttatttttttagcagtgggtgaaactaaggtatatagaatttaagtggctcctctaacaagtgtcagcaaagtaatggcagaactaaaacctttgacttctaattcagtgctctgtagcatacaaagggttaggtatccaaacataaaagaaaacatggaggtatggacaaagagtgatttgcaggtaaggcaaaagagttaagacttcaaagaggaaaaacaagacgaagaaggaatagagatgaagagagatcaagaagatatctacaaaagagaaaaggagggatggagaacaaaaagacaggggcagagaatctgtaaaaaacagagaaagtcaaagatgatatagtgcagcacaaattcaaacaaaatgaaagagaaagactgccgaaataaaaatgcagggttagataactggttagtcgctctccgatgaaaatatctaatgcaccccccttgctggtatgcatgaggtcctggcctcttaatgagtccccaggcttcctatgaccaggcctggctgacctcccccacaactcattccgctcagcttcctgcctctaggggtgtcttctgcagggactgtcctgcttctccactccactcctggatattgcttggttcattccacctaatcctttgcaatatcatctatttcagggaatcttcccatcccctcttcctactgtccaccctccagtccaggcagggttgtgagaccctcttctggatcccacaacagcccacaaactcccattatattatttatcacaatggacggctaatctctgttttaatgttaccatttttctcccaacagactgtagatttcctagggccaggaattaggttggattcatcttgtatctccagcaattactgcagggtgaaaaatatactgttacactcaatgcatgactgatgaatgaatgaagggacaaaccactccttctctcaggagtgacaaattatgtcgacaaccactggggggtgctcttgggtaactccagcaatgggcctgggggagcaggcggtggaatttctctgttacaaacacctcagcaaagcagagaaggcaaaagtgataccaaactggagagatccttctagacttcaccaggtgaggctgagaatggaacaaagcctgccctagtggatgaaagaataaaatgaaagtcagagaaaatggactcgagtctatggaactggttagctctgtggtctgggggagtcactcatcactgaagggcagcagttcacttgattcacacaagcccaggcgatggccattattatccccggccctcacctgccgggaatagaaggatgaatgagcaagacagcgttctgttctattgaggaaaaaaaaaaagaccttaatagtacaggaatggggttatctgggattcttattctaattgccaacatttattgcatattttctatgtcaaacatgattccgagcactagcaatgcaggtctgagcaagtcactgccccatgttgcccgttctctagaggaggaggaggaggaggaatagagacgtgcaagactaaccacaattttaagaaaggaacgagggtttgatgacaaaagagatataggtaacatgccaccacagtgacatttggtctgagggatcagggaaagcttcagaaaggtggtaacatttttcccaaccagacctgctgggacatttaggttttattagacagagctgagtcaacatgatactctaggctgatggaacagcccagcatatactagcaggcgaagatgtgcagggtgtgtttgtggaagtgtgagcagaagatggaatggaagtaaaggctagagaggtggatttggctaatattaacagcaggcaggatgcgctgtcagaacagcagaagtggcaatcgttggggtggaagtggctgcagctacagggaccacagtagcagctgctttgatggtgcagggtgccaagaactatactaagggctgtgtatacaatacctctttcaatcctaactatctacgtatctatctatatattatgtaaatacacatacatatgtatatgcatgcatgtgtatatttatgtatatgcataggaatgtctattttatcaacatgtagtttttatttccatttcctaagtgaagaccatgagacacagaggggttaaataacatatccaaggtgagtaagcagcgaagtcatgatctacaccgaggtctgtaaatttccagaggcaatgcttttaaatgctatactacacctcacccactgtcaggctaagaagttgagaatttatcatgtaggccaagagggagacaccaaaggtatctaagggaataacacaatctaacaaatgttttcagaagatgactctagggccactcctgccccaacatccttgggcgatccctgccctcctatttttaatggagccccttctggggcaagaaggggtggacatggtccatttgtagcagtccccaaatctcccaaaggagtccaggatgagcccagcccctctgacaaatgctccagcctcccctagccccagggagtgatttatcagcacagcgtcagcgcctctgcccagcagcctgtgatccaaggctggcggcccaggctggggtttttaattagctgagagagggaagagtcaagccctctcagatggaaagaaagagacacaccaagaaggctcatgaatcctgaaccaaggacccatcgactagagtctggcagtggtgggcagatggaggggaagggggagggggaggaggaggagggggcaggctgattgtctttttggcaatttcatggtctcccttgttttctggtccagacactacagggagaatgggaattcagactacctttcacacaggaaaccctggagtacacccttttctagtgtgactttgtgaccagaagtcagagagcctaatatttagctccatctttgccactgaccttctatataatttgaggtaaaaattacaacttaaaagctttcaggctttggagttagacacaagcttaattctcttttccatgctgtttactaaaactgtgactcagtcaagttgcttttcctctctgtgcctcagttttctcatccatcaagtcaggacaagatctcatattgtaagggctaaatgagacagcacaggtaaattacctgtattaagaagagaggttcctccagtctcctgaagagaccttcagcaggcatcccaccatttaactccagggtcatttcagatcacaagaatcatactgaaagcctgctccataggccctggggatacagagctgagtgaagtagtctctgcccttgcaggcttcacagtctggttggaacagacaatgagatgggcagttacagagaatatgagagagagctgtgattgggggtagtagtgaattccatgctggcataaaggaagggcacctgctgagcttcgtggacacctggtaagcacgctggagtggggaatagctgaactgatttttaaagaacaagatgtcactgttgagggtgaaaaggcaagagaagattatcccagacagaggggactgcgtgattagaataagatggagcagaatgcctggcacactgtaggtcttcaaaataatttctgtcgaataaaggaaggaaagaaggaaggagaaaaagagggggggatagaagaagggagggattcatctcattgaaagtttgaggggcagagagttgagatgacactggctaagtgatttgaactttattataatgacaaggagaaaccatcagaaggtttcaacaaaaaagtgatgttttcagacgtgtgtggtagaaaggtcacttttggaagttgggatgaagaggacaagagtggggtgaaggagaccagttaggaggctgttacaataattcaggtgaaaatgacaccaacttgtctaaggcaggggcagcgggggtggagggagagagcatctcctttaatacaggatgtagtcacagaccacacctacctacctgcctcatgtggtccagccccatcaccatgacaacagcctctttaacatccctggccataaagagataacaactcttacatctgttcctggaggtcctgcctctatatttttttcctttctttttcttcttttttcccctttgattgtatctgatccagccttactgggtaattgagtgtttgagagtgaaaaattatctcagcagcttggcccttatcttgacagtgaagcagcacttttaatttaattttgttcagagacgcatgggtaacaaatttcactaatcgcccggctgttgccctctgcatggtaacgagccgtttgttaccaggcagcccagcataaatacatgtgggagagcaggcaggggagagagacagaggttgggaggaaacaagggacagacacaatcaatatgaaccaggcttgggctctgccatcaggtggagaaacagagatggaaggccaactgcattagcacagagaggagttttggcgcgagactcaatggagctcctgtccttgttctgtctcctatctgggtgaagttctgagcaagtgatttaaactttccatattttagggttcttatctgtgaggtgaggtggggatgttcacaatctctacttctctgggttgttgtaagagttaaatgaggagctataaagtaagtaagctataaggtaagtaagctataaagtaagtaaggagctggccgggtgcggtagctcatgcttgtaatcccagcactttgggaggctgaggcgggtaaatcacttaagcccaggagttcaagaccagcctgggcaacatggtgaaagcccatctctacttaaaatacaaaaattaggaagccatggtggcaagcacctgtaattccagctacttgggaggctgaggcaagagaatcgcttgaacctggcagatggaggctgcagtgagctaagatagtgccactgcactccagcctgggtgacagagcaagactctgtctaaataacaacaacaacaacaaaacaaaaacagtatccctaaaaacaatgtcatgatattcttgaggctgctaaggaccttaaaggaaaaaaaaccctggcccttcatccaatgtttggatttctttcagaacatcctccacaggttattgttcaaattttgcttgcattcatctaatgatggggaactcactgtggaagcagacaagaactctgacactcagaattgtcttgcttatgctgacctgtaatatgcacccttcaagtcccagcctatgttagcacagccctgccttcttgacttctgtaaagagtcaatgcgcaccctccttcccaggtgagctcctcccttagacttgtatatagaaataatattgtttctcaccacacccaagtcttcttgtatccagctaaaaatatcctgtagagcatcagagctagaatagcctttataagtcatgtaacacaacattccactttatatattaggaaactgaggtccaaaaagaggaagaaaattttaaaaaataagttgttattttttgagtgcccattatgttttctccctgtttccagttttccaccattatttcgtcaggcatctgtctctatatttttatccattgaagagccatccttgatttatggtcttttgtatcccaaagccattactccaaagcacctcagccatggacatatgactcacactgcattatcttactttggttaaaaaataaaaacaaaaataccatgttattagaagcaccgaattggagaatcaggaaagacattacagaattgtagtttatttaaccagagaagaaccgaggccacagaatttaattgatctgatattctctattatttattataccctctatagcttgaaaatggctggagggcagagaccactagtcttaaccatctatgccttggttccttaaggcaatgattctcaactatggctgttcctggagagctttttattttatttttatttttattttttgagatggagtctcactctgctcctcagtctgtagtgcagtggcacgactttggctcactgcaacctccacctcccaggttcaagtgattctcctgcctcggcctcccaagtagctgggattacaggtatgggccaccatgccctgctaatttttgtatttttagtagagagggggtttcaccatattgggcaggctggtcttgaactcctgacctcaggcgatctgcctgcctcggcctcccaaagtgctgagattacaggcttgagccactgcacccggccatcaactatggttgctcctgaagagcttttaaaaagatggtcgggtgcagtgaatcacacctgtaatcccagtacattgagaggccatggcaggaggttcacttgagtccaggagtttgagaccagcctgggcaacatagtaagatcctgcctctacaaataattaaaaaattagccacgtgtggtggtgcgtgactgtggtcctagcttcttggggggctggggaaggaggattgcctgaggctgggaggtcaagtctggtgtgagctgcgatggcaccactgcactccaacctgagtgacagaatgagaccctgtcgagagagagtgagagagagacaggcagaccgaccgaccaaccagcatgcccagtctccacctaaacctattaaatcaaactctggactgaggtccaaagttaggtatttattatttaaacctaagtgtgtttaccatgcagatagggttgggaaccatgatacaaggggaaagagccctttactcacaacatcatgcttcatggacagagaaaaaggtcaggaaccttctcatggtctagaacccttttcaactggatatttacttttgatttttctttctctttcttctttgtttttcacaattaagtaaaagtgagatatattcattcctccagggattccaagaccagatacatgatggcttgaataaataataaaagggatgaacactgtttttcaagatttcaggtcaatctaattgtatcatagacaattgagagcagctgccctagttatagaaacacagtctcctcctgtataagttaaagtagtcagatctaaggctacaattgttcatcacttaccatcttctccaggacctgtgctaagtttgttgcttttattatttcattacaatcttgaaaccactcatagaagaaagagctacaagaatggccattacacagctgagaaaatcgtgggttggttagagtgacttaccaaggttcacaccgcgaggacacataactatgtgtgtctggctccaaagaccacaaattaaacactgcacattaaactacctccagcaaatccacccacctcaaatccctttcaggaacaggcagagtataaataataaacagaagggtaaatacatgcataatatataacattgtgattcacctacatatttcttttttaaatgagttgatttgtttgtccttaaaagtaattattgtggtttgtaaattctgccctccttcaaaaactcatgcttcattcacacttatctggctgtataatattctctcaagtggatgcatcatcatttacttagccatcctcctattgttggacatttgggctcattctaatttttcagtattagagattatgctacaatgactatgtttaggtttagcacttcaagaaaaatgtacagtgtcacagaaaaaatatggtaatataatgccgagtgaaaaaaaacaggagtgcaaatgtgtgaagattatggttgcaaggataagaaagagtgtgcaggaaatggggatggggaaaaaatgaaatgagctctcgaaggttttcatttatttctatttttctatgtccctttagtagaattattacattattttacattggttgaagaaaaggtaaaaacaatgagcataccaccaccaataaggttgaaacagctcaggtccacagatatccttagagcagagagatgagcttaggaatcagtggtcttgacttcttccacagacagaagcctaggaaggagcttcctaagggctggagtcatgtcttgctaacccctgacaccccagagaaccacactgttcctagaatctacaatgtgtattaaatgaataaaagcataaaatttcagagctttaagaggcctctgatgcaatttcttcaaacatcacacccaaatgtaatggatagagagccaaggggactttcccaaagctctccagcattttagctcctgaaccagagtagaggccactttttctaaagtctactccaattagaaaaggcatatggcaaatttgcccaatgggagctgtggaagaaaaatccttcgccagtgaaacacagaatgggtttgactgagtgacttggggtactgcacattgttatgcatgctgaatgccttgcattgttagttacaaatctcccctgaatccacttgtcctgcagtctctcagctgttctcatgacaaatgcccctgggctgtggcatctgttttcttcacgtggagcactagttttatttgcaccaaagatgttgagggaaggacatgttctacccagaatccataaataagaaacataccctcagccccttcactttccagtctacaccctctcctacaacagtttcctactgtcatgcctttatttacctccaggtaggaggcagaattttaaaatagcctccaacattcccaccccctgcacactgtctgtatactccccttaatgtgggtgccactgtgactatgataggatatcactccataattagattacattatatgacaagggtgaaaggatttttcaaatgtactaaaggtctcaaataagttgacaatgagtttatcagaaagaagttcatcttgggtaggcctggctgaatcaagtgagcccttaaaagagaatcgggccttgaaggaggggagtcaaagtgtgatgatctcctgctggccttgaataaacatgttgtgaaccgcctacaggggagacatgtggcaagggcttcagagcggcctctaaaatctgagaacggtccctgctgacagctggcaggaaaacaggcacatcactcatacagctacaaggaaatgaattctgccaacaaccacataagcttggaagaggattctacatgtcagctgcaatggcagtccactgaccccttgacttcagcctcttacatgatcttgagtaaagaacccagttatgccatgactggactttcacctacaaaactgggagttaataaatgcatgttctttgaagctgctatgtttctgtcaactggttactcatagaaactaatacacgaccacagagtgctgacatccacactctcccctcaactagaacactcctgagctcagatctggttggcaaatgtccccatctggatggctcacaggcacctcaaaggcagcagctccaaaatccaactagtctctttctctcctgaacacttacccttccttccttgcctggctgtgtgattctcccagtccctatgctggaaaccaatgctcactttcagcaatcttcagtggctcaccttcttggagtcagtcagtcattgggttcctctaactgtatttttaacatgttcctgtatctaaaccttcccatgctcacccagagtgttcccattctaccccaataacctcctaactagtctccctaccttcagtctcactctcttccagttctttctcttctgtagaaagtgtgatcttcctaaaacagaaatgaaataatagatcccttccttcaacagtaaatgccttcctggccgaggcaggcagatcacctgaggtcaggaattcaagaccagcctggccaacatggtgaaaccccatccctactaaaaacacaaaaaattagctgggcatggtggcacatgcctgtggttccagctactcgggaggctgaggcacgagaatcacttgaacctgagaggcagaggttgcagtgagctgagattgtgccactgcactctatcctgggtgacagagtgagactctctcaaaaaacaaaacaaagcaaacaaaaaacacccttcatagactcgtcatttcatggaggttcaagtgcaggctctttcctgctcacacagacatgccattttttagagcttggccacctctcgtccatatttcaggtataagctataatattggcttcttaaaggtatagttcatgagtctcctgattacattagttcctcttttcttttcatcagaggcagtcctcacagtttggaataatatatttattcatgtgtctatttgtgaaatacactctcccttccctttttcctctggcatgactagaaatttcataaggaaatccatcctattggtctatttcccaccatattcctggtcttcagcaaagagtctcagtggaattagatattcagtaaacattagttgattatgcaaataaaaaaaaatgaatgaacttggcattcaaagcgtttctcaatctggctaaatttatccttcccagactttttctcactgtcttccttcacataccttatattttaataacgcatgacactatttaaccatcacaaaaaccctgtgagataggattatcatttccaattttgagaggaggaaatccaggcctgggaatgtacatttacttgcccaaaatctcccaaactgacagtcaggattaaataaggttatgcatgcaagcatctcacacagctggtgacatacagagggtgcccatgaccagtggcatggtctgtttatctggaaaagagtttttcaggggtaagagaacactggccgtctcacagcgttgggaagaaaggggatgacagagtattcttgcttggggcgggaagcaaagagtcacagtctctcattctaaggaaaggcgggtgggggaatcctgctgagcctagttgaaaaacaagaaagcaagagagactgattattccttctcgctagtgtaagcaactaaaatgacatgtttgctttatcgcctttggtctcccatttgattcctgacagccatctccctcccttcgatggcgggctgtcaggtgctgagctggctggcattgcacaggaagaggagtacagagaacaatttaaacaatatttcagggaccatcatgggctggaggagggagtttttatagttagctggctttctttctgcattcaaggaaccctcatttgccaagactgcttgacgtttctgtgggtttgggtagaagtagtccagaagggatctttaagaaaaaaaaaaaaaaaagccaatgtctattttctttgaggtttgaaggaagggagagaatagagacagataggagctttttaagcccataacaatttctgaatacataattttctcttctctaatgtctcgttaaatagggccaaatgcagatgtagatcaaagctaggtttctgtattttactgcattttactgtgcttgcaagtaaagggaatccaaactcccagtttctctgtccgtgagagaaactagaatctctccagaaagcctgtataaactaccagaaccttctggaggaaggagtccactcccacaaaccacaaacagctgaacatttgagcaagagttacggtaagcaaaaatgagcaaaaacctacaaagttctcttaggggacagttctgggggattgtgaccatgaacagtctttggagccaaccgaaacccaattcaagccacagctacgcaacttattggttccattatcttgaagaagctactctgtttagtttcagttttgttcttttaaatagacacaaggacaacaattgattgctaggaagattaatgaatgtgcaatagacctgatacaaaagtgacacttaatacatagttgctataagtagttattccccttataatggttatctaagttccaggcttgggaaatggggggatacactccataggggcccaaagccaggatgggaattggaatgtgttgttggctgatatatcaaggaagcttgagagtggtggttctcgatgctggctaatattaaatgattagaatctgaaaaggatttcatacttatatccagacttttggccagacagtcctatgaaatgggttgattcttggaattggcattttaaaaagtgattctgagatttatttaggctaaagaactacccagccctgacagctcttcttcccacacagcctaggacacctgccttgatctaggtcctagaactcacgattctctcaagtaggaagcaccagagtgcccagcctcctatgcaggccctaaatattcagcttctccagctgaccttgttgtcttctgtttctgaaaaggaatcctcttccttgggccttggatgttgtagtttgctttgtgcctgccctccatgccccccacaacccttcatcatctagtgcatcatcctcggggaagattctggattgcttagactatttctagaaaatggtctttgaatcctagcctgtggctaagttcttacttcttactgacagttctccccagtggtgtgctggtaattgtttaacaatgggctctcccagcaagagcaagcagctcttttaaaatattttaagtattttccagtttccatagtttgaatctttctcctatggctgattacaagctcccaatgtggcatcactcacagcagagttgggaagagatgagtacaataggctctcgataaactgggatgggctggtccctgcacagcactggaagtcatccttgtcatacgttttcctacctgaccaaataccaggccccctttgttggtggtgccctgggacggctggtcctacggatgctgccttttgtcctccatactgaactaacttttcagtgcctgagctggttctgaccacgactatttctggtcccagcccctcccaggctacctttccccaacatctcaggggttacagagctgataccaggaagttctcagggatatgatcaggtttgctgtatcagacacagacatgggtatcctcttcctgtctctttttgagtatataccttgtgtcaggcactgttgtatgcactttacatgatttatctcattcatccttataatggcctgaccagattttgaaatcaaatagcttaaatacaaattcaagcttcccttaactcatggcagcctcaggaaagtgaaccctctcaattcttagtttcttcatctgtaaaatggagagaagaataatcccttctcctggtattgtttagaataatatgaaatcatgcatttagacaggacagaacagcatagagataattcaataaaactaatacagtttcttctgttcttttcctctatctcccttcttgttgaacccatttctattatggaccctagaatggttttattgtgaactcagagagggtcatattctaccttgctggtctacagataggaaactgaggcccaaagccttgctcaaagcctcttaaccaaacaagagacacctaggattaaaactcaagtcttggccgggtgcggtggctcacgcctgtaatcccagcactttgggaagccgaggcaggcggatcacaaggtcatgaaatcgagaccatcctggctaacatggtgaaaccccatctctactaaaaatacaaaaaattagccaaacatggtggcacgtgcctgtagtcccagctacttgggaggctgaggcaggagaatcgcttgaacacaggaggtggaggttgcagtgagctgagatcgtaccattgcactccagcttgggcaacaagagcaaaactccatctcaaaaacaaacaaacaaaaacaaaacacccaagtcttaggacttccagtgatttcatgacatcctcttgcttggctcttcctcctcctgtccctcacccagcgctttctcccctggctttccaccctgtcttcacttctcccggctttccctgtacccatgtccaggccctgtaataaccagataaacccaccccatgaaggcgctgatgcattcacctgtgggtcctctagctaaccctttttcttgagcctctagtcatgtcttcagtgggaatccctgcagggtagggagtagcaggctgatctgccccatatcttggacaccatttcctctccttaaagcctagccctctctcccatgttactctggctacaatgacttagaggctgatagaatactgcttgatctgtcttcagtgtttactctgttctgagtagcaggtcctgggggcgttctctgcaggttggcaaagggcagccagtagatctgcccatgagcaaggctacctaaatttaggcaagaagcagaggatggtgacgtgaaaagctgcatcacaatatccccaaggggctaggcctacaaaattcacattttcaagaaaaatgtttattgtttttttcttttcctttttcatttttttctttttgtttgtttgtttgtttgtttgtttgttttttgagacagggtctcactctgatgcccagtctttagtgcagaggtgcaatcatggctcactgcagccttgacctccagagctcaagcaatcctccagcctcagcctcctgagtagctgaaattaaaggcacatgccactacatctggctaatttttttgtagagatggggtttcgccatgttgcccaggctggtccggaactcccaggcttaagtaatccacccaccctggcctcccaaagtaccgagattacaggagtgagccactgcgcctggtcactattgtttttctagaaggcagattaattttcaagctggtacattagaaagaggacctggagcctgtgtggctcaggcactgatgtgctgtaactggctagcaatgaaacaattgcatggtggatgcactcggctaagcatttcctctgcttatgttatctcatttaatcctcataacaagcccaaaggagaacagaaggacaactgctacacttatcctcctttacccaagagaaactgaggtcagagaacaaatgtgtcttgccttaggttctgcaatgctaggaaatggcagagcaaagatctgaacccatgtctactgattccagtgcttatgtacaacctagaagccccattattttctgggtatattactggaaataatttcaacctgacaaagttgcaaagataagaagagtacaaagaatgcctatctatctttggcctagcttcacctgttgttaacattttgccccatttgatttgtcatttgaggagatgacatttttaaccttgaggaaaatgtttcccttctctgagccttggtttttatgtgcataaaatggaagactgaatggattacctttagagtgaaacggaaccttgttgcttgatgagaagtgatggataaaggatgaggtaagcccttggtcagtggtcaaggcacagttgctgcctctttctccggcctcattttccatcattcctgcacatgaatttgggctctactcagttctggcatctctcctccacccccttccccagtgtaccacgtaccatccgccctcacaccttggcaggtactcttccacagatgctcagctttcacttcatcccattttcatttcctggagtctctgatccattttgggactcatggcttatatttcataacaggaggcttcagttcccaaaggcctcctctgcagatatgacttgaacttttcctcacctatccttttcctcgaaaacaggattaaactgtgtgtgttggaggtgggaggagaatcataaagaaaagccatacatccacataccttagtacgaagttttgcttatggattcagtggttcttagttacagaaaatcccagcttaggaattgccaaattaaaacaagcaacaaaaacaaagaaataagacaaccagtagcattcatgctctggttctctctgctggagaactaagcagcaaagcttagaggaaagtacctgagattggggatcagaaaacctggatttctataactggctgagcaacctgcagatgagaaaagcgaggtccagagagggagacagatgcacccaaacccatacagcacagagctgggctgggaggttcatgctgggtgcctgcactgctgaaatgatccagcagctataacagctccgtctcctgctcagcattgtgcccagggctgggcaaaccacctgcacttctcatctggactttcagctgtacagaagcttatcctgattagcaacgcttccctgtgtgagtttgcacactccttgcctccggagactgtaaccactgtgaggttcggtgctgaggctccattttctcactgcccagcagcatggttattagggttgcttattccacacatacaggctaaactacaacggggctcagtcttgatgacatatgatgtaaatatccttgtatgacaataagaaagttgaggtcccgagggagcacaggcttgccaaggtcactaagctagttaatggtgaggtgtggacttgagcacacatctcctgactctgagtccaacattctttgctctatggagtactatctccgatgaatatatgttaaattcttcccactagtaacctactacattagctagtttattacttaattctgtaaaatgccatcagaattggcacacttaaaacaatgatatactggagggttatttacttgatcaaacatagaatgccttgcatgacaaatagactcttttatttattttttgtgtttttttccccattctttattattttttttcataggttattggggtacaggtggtatttggttacatgaataagttctttagtggtgatttctgagattttggttcacccatcacctgagcagtatacactgtaccctatttgtagtcttttatccctcgcccccctcccacccttccccccaagtccccaaagtccattgtattcttcttatgcctttgcgtcaccatagtttagctcccacatatcagtgagaacatatgatgtttggttttccattcctgagatacttcacttaaaataatagtctccaatctcatccaggttgtggcaaatgccgttaattcattcctttttatggtcaagtagtattccatcatgtatatatacgacagtttctttatccatttattgattgatgggcaacaaatagacttagacagaatgatcatatatgatatggggttagacttattttcacagagcatggtgaatttgtacacatgcttcctggaccagacatacaggtgagggtaacatatcaatggtttaaggcaggagtcagctaagtttcatgggtgaaatctgaactagcacctgtttttaaaaataatgtttattagaaaatatttatgtccattcatctatgtgttgcctatggcaggtttcacacagtctaacaacaaagttgagtaggtccaacagggactggaaggcctgcaaagctgaaaatgtttattagttggccacttacagaaaaatgttgctggccccttatttaggaaatcccaccagacacgcatatcttggtctctccacctctttttctccatccctttgcctttttctccttccttccactctccatattgatggctacagttctgtgctttgggaagaagttctacctggaaataccagacacccctccaaaatagtcccattctccttacaaagagccaaaatcttaggaaagacaaagtacttccaaactatatgtcaaatctctttcataatggatcctattgctgaaaatgggatttgagctgatttagtttggagctcagaatgttttgaagggaaagaaaatattagaagacagaacaaatatttcttgggcatctttgggtaagacccagcaccttccactgggtgcttactctgtgaggcaggtgtcaacagctccattttatgcaaagggaagcacccacaggttaaaatccacccagggccacatggaagggatgacaaggtgaggtcaggactcacagccaggtctggctgaatctaatgccagtcctatttctctcatgggatatgctaagagagagatctatgtacaaacacttgttagagatttcctctctccttctcctccatgccccactcccaccactagccctcagtgtaaccttttctgccatgcagccttctggcctggttacatcgttcccagatggcacacaggacagtcacactcaaagaacccaggcagagtgtgcttttcaccaccaaggccctcttgccactgctgggcatggccttcctggtggccttgcagtagaaaaatagggagaggtaaggccccagctctgcttaccaggagcaggaaaaagaagggaagaggagagcaggccctttcccagcaggcaggcataaagcgagacaaaacaagaggtggcagacagaaaatcagcctccatcctgaacacctataagccaaacactgtgcaggtgtttctttcaaacattcactcatcattcattcattcattcaaaatattcacccagtgcctactatgagcccatccccctgtgcttgatgttgaggacaaaactggacacaaatgacaatgtgtctatgctcgtgaagtttccagttcagtggaggacacaaatagtactcagggagcatatcagtaagtgtaaaattatagtggtgaccaagtctacaaaggggggtacagcacagcatctggtatagaatgagacagggaaattaactcaggtatggacagctttgcagaaaatatgccatttaagtggaggtctcacgtgatgggggggcaggtgaatgagtcaaacggcagggaagagcattccaggagacaaatgttgtgaaggctgtggcaggacagatgcaggagtgctggggaagaggccccgggggagaggtggagtggggagggaaggagcggacagagccctggggagagagtcagggcaagatcactcaggattgcaggtgtgtagggagtttccatttcatcctgaaaacaaaaggaaagcattgaaagcttctaagaggagaaacaacatgatccctacttacatttgtaaagatgatcactctggctacatgattgagaatggactggaagacagcaagggagacttagcaagagaggacttttagcagttttaaagcaaaggatgcaggtggcagggactaggatggcagcagtagagaaggggagaacttgttggcagaagttgaagttataaaggagatactcattattttaatcttcacaatgaccctgtgaaggagatgtagtgactgcattttaaagatgggaatttgagaatactggttcatgtcccatggatgaaaaggggcagagccatgtctgagactcaggcaacttcccagcctcaactctttcaggaagccctcccacatttagctgctgtttattgtgtctttcttctcccaaagctgggataatctgaaacgctcagttcaataactttgtcttccaaaatcttctaacatctgaaacagtctgaactgcagtgcagggcccttaaccagtgctgatctagttgcttctgagcactcctcttaaatctctacttagagattgaaaaagtgagactcagagaccagcagggacttggccaaggtcacacagaaacgtggtggcaaagccaggactgaaaatcactgttcctgtcacacacagatagccccaaagactcaacttccttctgagtacttcaaagatggtaaagttgaatgtctttatcaaagcccacatgcctcgagatttggaaaacacagctcagctcctatttttcagatagacctgaaatggttacagtgaattcatatggagtcccaaatgctattagatgaccattctcaactagcacagggaactgcctttcctggtacttttatctctttcttcccctacctccttgaacttcatcatctcttctgtgtcaccgctgggctggctcacacacccctgggcagactgcagggaactgctgagtcattgcctttgctaaagaggagctgaaatggtgatggcagaggaataggagaggactgggatgttacaggtccaggcaggcctgggggtgtagggaagaaagaacccatcagcccagccaaaggggacaacagaaccattctagtgtcacagttagaccctaaaggagagaaacaggaaaggggagtggcactggacatgggggaggtaaacagggtgcaaaggaacctgaagctggaagccaggtatatcccaataacaggagattctcagaaatatgccccatgtcccattcacacacaagtaagaagagatctcagagaagatccacccgtccactctcccatgtttcagattgaaaaacagagatctggataacaaaagagactttactaaggtcacacagtgagttggtagcagatctgagactcccttcctgtccccatagtaaatccaatggtccttctcagcaacttcactctgccacaatttctctccctccctatctccacctaaatgccttgcaggtttcaagtaattttaatctttagaacaactctctatgctttcatcttaatatcctcattttacaacttagggaattgatgcacagagacgttaagttccatgattaatatgacattgccagtaagtgggggggctgggatttgaacccacgtaacccaccaccagaatccatgcttttagtactatgctctgttgctcttatatcaccaagggctcctggacctcccttggctcacctctgtcctgtgcctttttcccattaagtcagtgaatgctgaaggcaccctaactcctgcccaaactatatgaaacagaaaaaaacagatcacagccctttcatgaagaattgcgggacttgcagactgagacattgggttctaagttcatttgcctagaacaaagatgttgcagaaccaaattcactctctgtattcaacaacaaaaaattatagcagctgcggcagcaacaacaacaacctaacaacatcaaacacagtattaagaaagctctccctgtgatcctgcaaaaagcgtagggtaattcatgctcactgaatctaagcattcaattccttccatattctctcagttcccttccttgttgtctccttttcttttagcatttatcaccatctaatagatttgtattttgatataatacaaaccccacaagagcaggaattttaaattgttgtttggtttgtgtccccactgcctagaagagtggcaggcatgtagttggtgcagaacaaatatttgtggtatgtatcaaaggaagaaagaaaggagggagagagggagggagggagggactaagggagggagggagggagaaagggaggaagggaggaagggagggagggaggagaggagaggagaggagaggagaggagaggaaaggaaagagggaagaagggagggagagagggagacagggaggaaagaatgaagggatggaaggagagagaaagaaaggagttgctgggttaaatcattcatctcgaggcctgtagcttgcttttgcttttctaagttgaactccaatttataggggacatgctcagtgatgaatgtttttccaattatctataaatagcccaggcctgctgaggggacccattgacttccccagccctaattctgactgctggattgtgtgagggagaagaccagtcaagaatcatcaatcgtcaacttctaaatctccaatgcaggttcccggaagctgaggattgcttctcagttttctggctaagatcaagtggagaaagctgaggagcaggaaggagggagaggcagatcccatttttccaatggctacagaggctgcaaacccttcccatgtaatgtgtcaatggaaacactcctcccacgtggggcttttcagggaaagatgccagaggtgaggagataggaaaaacaacagtgagaactgaactgacattaataatgtctgacttattttgcttttagcatacaccagacaccataaattttttacatagcttaaccaaaattcatccacaaccccatgaggcagttacaaggtacagcttgtagatgaaaaactgaggcttacagaaggcaaataacttgcctaagagccaaaggagcacacagaagttatggggatctgtgcttttgcagtgtccactgtgcatggatagaatgcatgcagcatggtttgtgagaaaagttcctcctcctccttctccctaccccagctacttctcagcacacctctttgtggaggtaggagagaaggaccagtttccctgccacatgacctggacttgtcacaggaccttcttttcagtgggtgggtaaagcccatggatggatctgccctttatcactggcatggaatccatgtttgtaccccaggagagtctcttccaagaatccagtctcaaactggctgctttcccatccttatagacaatccaagatgaagaatcacattcacaggcaattgcctgaaatatgctgttttcctttcagagcacgttgaatcatcagggaacgatggatcttggccacaggttttagacctttgtggagtcctgcttcagcatttggccatccccctacattgagtgccattgtgagaaataattatccaatactgaattttatctgttgaagaaactgcctagaaaggcacacggtatcttatttatacataccaagttgaggactttacctctggtctggtaagtaaaatttcctgaacaaatgcttgattctttcccattaaccctgtacattttatttctgagtatgtttcccttcacactttggctgccgggaatttcttacttaaattgccagcctcttctaagaactacaaaacagtatggcagggattattctgcatcaacccaacctgggtttgaataattttccttattcttattttcatattaatatgattagttatttcatttcctcttttgaagttttaaaaatctgcataaaccaaaaacaattcacagtattttttgaagaataaggtgggacagaaagcaaataaagaataagccaggaaaagcattatactgaaggtcacccatatagccagggcaacagatactaagctcagttttaaccagatggggaccaggttagagaagatttaggatttgctagtgaacacaaaatctgatttccaggatttccttctacaaactctggttctggaaccttccaaggacactattacctttgctgcggcggcgactgcggtactgctccgtgtagaatgtcagctgagtttcatcgtctgcctctgagcccgacgtccccttggctctcccaaagctgattcctcctgtgagtaagcacagtctatcagttagtctcccaggcctccagaagtttgtgagattcctcaaccatcccagagatcagcaatcccatccccagacttttctctgtaaatcccaagcaacccaggagtcagtgtgataaatggaaggagttcatgctctgcagtgaagcagatcttgggtccaagcatgactcagcagcttctgagctgtgtgaccttgaagagaaaacacacctttctgagccctgggttctgtctctctaaaatagggataaaattattcaccttgtgagattgccttgaagattaaaggagatgtaatatataaaatacctggtccgcagtacatcctaaacaactgatagctattgttgcttttggtgataagcaaacactctagaaaacactctagacaacttaattttaaccacatttcaataaagtgcaagacgctggagatacaaagataaataggactcagtctttgccaggcacgggatcataagctagtcagcaggacaaatggaatcctaaggaagcttaaacctaattcatggcttctgtttaccactcaatgaggtgctaggaatatgggggagtgcaattcatttcaacacggagggcctgagaaggttttatgcaggagcgaagatttaagtcaggtcttgaaggatggatgggcctgcactgatagaaaaaggacttccagcagaggtaccagcttgagcaccctcaggaatgggccatgtgggcagtcaggggcaacattaagtggagaaatgactgggaagacacacagcgggaggccttgggtgccaaacggaggatagggagctttacttttggtttcatggaaggttctggagcaagagtatgaattggccagccatggtatatacaaggaagaacactccagtggtacctaggctgcaggatgggtgccaggcagggtaagcagccaggaggctcagtgaccacctaggtgaatggaggtcagggcttgcatgagggcctgtgcagcgaggatgggaggaggagatgagtgcaaagggtgcttcagagacaaactcagaggagtgtggagggaaaagggtaatgcattcatatgctgtgaacagctgattgtagaaaggataaaaaagaaggctaaaagcaattatgccacaatactaatagccattaattccaaagagagaaatatgggtatgttttattgttatctttgtgctttctgcttttttaattgcctaaaggattagtaaattatttactctagagaagaaataaccaggagagagagcctctgaggatgttgggggtgagtagatgggcacgggagaataaggactttggtatttaaaattgtttcattgatggggcttcagacatctacagcaatagactttctgggaggagacttaagaatctggtaaaaatggttgtcctggatggagaattaagtgcctgaaagatgggaacagagggaggctacttttctctataaactctttgcatcttttcaatcaagcaccatgcaaacctattacctattcaaaaatttcaactaaggaaaagaaaaacatacattaaagggaaatgttattcaatgcacgaaaggatttattatgtaatttcctcaggtagggtatttgaaatggcattcagtatacagaaattctacttgcagacactttttctgcaatatggttattacacattcattctttctagcaacattgttgcacaatctgctatgtacctagaagatttgtagacattattgctgacaatcctcatcatgatatactcataagagtggtgtaattaacaaactagataataaagcaaagatgcaaagacatgcttagacatgcaaagttacttgcatagtcacacagcagatgactaggagagttaagcttcgaggctagtctgtccaactccaaatttggtctctctgtaatatacacattgctttccttaaaaccactcatgagcgaaccctgaaagagcagatcatccttcgagtgtcaagatgctaagtacagcattcagagctttgtatacaacatctcattccgaattcatactacccttaggagagaggcatcattgtgcctactttacagatgaggcaagtgatgctcagaaaagaaaaatgatttgctaataatgagtgaaggtggacttcgaaaccaggtggaactaatgcccaagctcaaatttctagccacttatgatgctgcctctcagtttaaggctctgtaaaattgaaagattaatatctgcctccccacacccatccttccttaagacggtatgttctaatgagtgggaaagtacaaaggatgacaacatttgatctttgtcccaaaatgtgtcatcaggcaaggtctgtcccggagccttagtgcacacttccccaatccccagcaactaaaagcagggcctggagacatcaggagacttcagatttcagattctgccagatgcagttctccatttaaaggcttagctttgaagtggaattggcagggacctcatggagattttggaagtgactggagagcagaggtccccagaagccagtagggcttttaaaattgccattaaaatattttactgttaaaaaaaaaaaaaagaagaagaaagaacaaagaaaagaagggagaagggctgggcatgatggctcacacctgtaatcccagcactttgggaggccaaggcgggcagattgcctgagttcaggagttcgagaccagcctgggcaacacggtgaaaccccgtctctactaaaatacaaaaaattagccgggtgtggcagcatgtacgtgtaatcccagctacttggaggctgaggcaggagaattgcttgaacccaggaggtggaggttgcagtgagccgagatcaagccactacactccagcctgggtgacagagcgagactccgtctccaaaaaaaaaaaaaaaaggagggaggaagacttttgttcatctatacataattcttggccaaagaaaaaatgaaggcatctgataaagtcattctcttatgttcagaaaacatctgccatactctctgctatgtctggagccacagagcaaaaaggagggtctatccctgttaggaggccacccaagactcttcccacagccccttggatgccatagccacactttgaaacatttcagcaaaattctcactcccttccttccttccaatctccactttatcttccctcccatcctaaacacatgacctgttatggccctaccatggtgaacaaatctggcttacaggaatcagactttattctttccctactggagcaagatagacagagtgacagaaaagtcaccaggaaattctaatgtaagaaaagcgaacacttgcatagtgcagtatctcttccaggcactattctaaagcctttacatgggttgactcatttcatatttacaagaaccctaggagataggttactacatttattcccatttcagttggtgagaaaatgaaggcacgtagaaattaaatattttgtccagggtcacagcttgtaagtagcagaaccacgattcaaattcagacagtggcgggtaaatctattccttttttacaatgctggtttataataaaatatgaacaaatactttgtttaatatccacagccatccctataaggactgtatcatgagttttggtttcatagatgaataactgtctcagagaggtgatacgaggtagtaagtgggagaaatgggattgaaatttggtctgtctacctgcaaagcttgcttcgtacctaatacaaccagggaaagtgtgtgtgtctgtgcctatgtgtgcacacacacatgcatgcatatggatgtagagggctggcaaatgcttgatatgttgaccactaaggattagcagttctcttaattgactccaacacctggacctgttttcttgtaggaactctaatcaggcttagcaagatctttgtgactctcccatctttccacatgtccaggcacagtgaccacacccctataactaccataagggtttccataaaggctttcccttctggtcaagcctccatttccaaactcttctgacctttattcccttcttgtaagtactaaagtaccatgtgttcagagtgaaaactgaggctcagaaacaatgtctataaaccagattcaatagaaatataatgcaaaccacatatgccattttaaatgtttcagtagccccattaaaagggtaaacataaaagttcaaatgaatttccagaatatgttgcatttcactcagtatattaaaatattatcatgttaacatgaaattaacataaagttattaccgaagtattttatatatttttcataagtcttcaaaacccagtatgcattttgtgcttacagcacatcacaatacagacaagccacatttcaggtgctcaccatattggagaacacagttctagacatatttgtacaacaaatattactgagcaaattaagggcaaggatctgagtacaagatgaagatgaataagccacgacctccactaaaatgttcaatcttaaaaaacaatttggatttttgacctggatgaaaaaatggcacagctgggattctgttaaacaacagtatctatggtccctactctcaaggcacttggagtctagttagtttctatatttgtttatccatgagccaagggaagtaatggacttcagtagaaataaattaagttattggagtcagacatgagttctagttctttgattcacttattagcatatggccttggacagggcatttgatctctctgatctcatctttaaaaggggtacaagaactcagctcaatggttattattgggaaaagagtatgctgcatgtaaacattctgcacaaagaccaagaagtgagagtcagggcacattcctcaattacttgatgcttgtctgtgtttaacagaatgaaagggaggaagtgctgctggtttgaggtgccccctgactctcctgcctgctgtgacatcctggggaggtggcagccacccaaggcatacagcctctgagtatccatataatctgaaggggccacaggccaattacagtctgacttggaggtgattcagatggctagaaaagggccccctctgttagcattttaatataaaattggtgatttagtgcaataaaatgcagccattagttacacagggctgctcccgtacttccatttaggggctgagagaaagtgagaatggttagagactggcaagaaaaaagaagaggtaatctatctgctggaaccagcagcctttctatccttgctgcttgggcccttggttcttctggtaccacagagcctgaggtggagccattaagaaggtgagctaaacacatgccacggtgtgataagtactgccccaggtaccttacatgcaatatccctcctacacctcacaaggggtctgagatgtaggagttaatcccattttattggtggacaaataaatattcagaatctcactgttgcttaatcaaaattacacaaatggcagagcccaaatttgaatctgatgtatgtctgattcaaaaatgctctgttctcataaaaacatgcttactgtcattagtcaatagaaaatgcaaaccgaaaccatagatatcacatcatacccactaggtgggtgataatcaaaataatggaaaatagcagatgttggtgaggttgtggagacgttggaaccctcatacattgctgctggatatgcaaaatggtgcagccattgtgaaaaccactttggtggttccttaagaagttaaacacagaattaccacatgatgcaggatttccactcctaggtatatacctccagccccaaaactgaagatagggcattcaaacaagtatctgtacatgaatgttcatagcagcactatttacaagtcaaagggtacaaacgacccaaatgtcaatcacctgatgaatggatgaacaaaatgtggtatatagacatagaatattattcagccataaaaaggaatactgatacatgctacaatgtggatgaatgttgcaaatattttgctaagtgaaagaagccagacattaaaggcaacatagtatattcatattctatttatatgaaatatccaggatagctaaatccgtagagatggaagtagactagtggtggctagggctggacagaggaaaatgggaatgaggggtaacagttaataactattgagtttcttttaggggtggtagaaatgtcttggaactggacagaggtgatggctgtacaaccttgtgaatgtactaaatgccactgaattatacactttaaaatgatttattattattattattgagacagagtttcactcttgttacccaggctggggtacagtggcatgatctcagctcacttcaacctctgcctcctgggttcaagcgattctcctgccttagcttcctgagtagctgggattacaggtgtgcatcaccatgcccagctaattttgtatttttaatagagacggggattcaccgtgttggccaggctggtcttgaactcctgaccttagatgatctgcctgccttggcctcccaaagtgctgggattacaggcgtgagtaaccgtgcctggccaattaatgattaattttatcttatgtgaattatatctcacaaaacgaaaaaaagaaaccaactttttttttttgtaatatcactaaattagtgatagaaccataaatggggaatgtgagagctgtgagagagacagggagagggaaagttggggcacagagtggaagaattacatagccaccttgaaagaatcaagagctcagacctctggagtcctagcccagtgtgtggggatgcagaaggtgaccattcagtttgtcctagaccacatgttcacctaaaatcatcacaatactcactcatttgtttatgcattctttaaacaatcatttactcagggcccatgctgtcccaaacactgtctaggtactgaagataaagcctcaataaaacagacaaaaattactgatttattggagtttgctttctagtaggaaagcattttagatattcttggcataccattctagggcttagcaaagccttctacatgagaattcttacctcaattttgctgctaaataaatgaagatattcagagatatttaaagccttcccctagatggcatagatatttggtggtaaactaggaatttgaccccaggtgtgctctggggctaatcagggcatctgaacaacatgaaagtcatgttatggaaaagtatggagcaagatgatacaaggtctttcctgggcctatgagagttaactcactgctcttcttttgcaatctaccttctattcttgggctgccctgtccacagacctgctctgccagcctcgacaggcccagccctccacactccatctcctgctcttgctatcatgatggatggtggtgacatgttaaattattcaggctccgtgtcttcctcaagctggtgacagtgatattgcatttttagattacccagaactgtgccagataaagaaatatgtggttcaggaatggaaaaacccatctgacccccaaccatctagggaatacaaatggtcccagtcatagaaaaaggacagaagtgggtaaacttcccacaccccctataccacacaactcacaattgctctgagctctagagctaaaccacaaatgttcatacacattcacttctcggagatgttttgaccacaactgctacctgccatcaggcacctgctataggccaggcactttacacagaggttactatgctattcctccaaatgtggccaggagaggtggagctccttacttgtggtcacccatccagctaagtggaaggatatggattcaaaccctggtttgtctgatcccccagggaagaaatttctgcggcattcttgggattcatgctgaatttttaaaatggatttttatggtgaaaacctatatatgataaaatatagctaaacctgattgtttataatttcagggaaagaataagaaataactgagaggtccatttacagaagactgatgaaaaaatcatagcatatagtctttcataagaccattgaaaacagtgacatagatctaaattatagacatacaaacctctccatgacatacttttgggtaaaaaaatatgcagagaagaatacaaagagggactccacttgtgtaaatttatatatgcttgctcatatttggtatgaatgccattctgtgtatgtaataaaaataaagaagaaaaaagtaaaaagtcattctgagatggcatgatctacggttatgaacaaagttttaagaagcatataataaaacatattttaaaaacaacagtattctgtttttaaagtgcacacataaaatatatgtaaatacacacatgcaaaaacatattgaaggaaacatattaaggtgttacggtggtttttctctggatgataagatttaggtgtgctttaaaacatttcttattgttgctcctacgcatttaaaaattctcctccaatgaacttctaatgcttgctaataaacaaagatacctaataaaagctttgcttatttttttaataagtactctttattgctgcagtttaaacccattactcacttgacctttaacgtaatatggccatctcagagggggatcattccatcacccaagaaaggaaatgacccaatttatccctgaattttggcttaaataactacttacgagggagaagctcaccaatctagcttaactcactcttccagggaagtaacgctttgtcttcttgaacatcccactcctccctgtgggatggtatattttccaaatggggccataacaaaatctcccatcctgccttatcttttgcaatgagaccttcgccacacccccatcaaaggcagagtctcatttccctgcccccaaatctaggctggccttaggaacgtaactctaatctacagaatgcagaggaagtgactctgcaggatttctagagatagaacctgaaaagcaataaagcttttgtctggctttctaaaaacactggttctctagatgtttcctcttaggaaaactgccacggtgctgtgagattcttagccacatagaaaggctatgtgtaagtggttgagtcaagagtctcagctaagcccagcatttaagacatcccaccccatcccaggtggcaaaaacatgagagaaccttctagttgattctaccctctgccatctgttacccgtggatgttttgagttttccaagctgaagtccagtccttgtggaactgagataattcacctttcctttatcattatgactccctgactcctggaatccgtgagtataagattgttggtttaatgcactagctttgggatgttatatcatgcaaccataggtaaacagaacactccccttttccagtcctacaaaaatctccacactctttccaagttatcaccatatggcagcctgggcaatgggaagatgagctggtgtggtgtccagagaccctggtcctaggtctgtcctgttcctgacatacggtgtgactgaaaaatatattatcatctcacagatattgcataacagataatacttttactctcttcccaaacacagcagctcatttgacattcacaataactggatgatgggcattgctattcccacttgaaagatgaggacacagagggtcagagacactacagatgccttggtcaaggtcccatagctcataaatggcagagcagagaggagaatatagaaccaattctggaagctacagtagagtaagggggcagatttgagtatctgaggttggtcaggtattaagttccgtgaaatttccactttctagattccgtccagacttttgaaatggtagagtcagactgttagcttccctttatgatggtcctcagtcatctgaggttgcttatgtgcccactcacaatcttttcatccaagctacatatttcttttcttcttttttttttcttttgagacagaatctcattctgtaacccaggctggagtgcagtagcgcaatctcggctcactgcaacctccgcctcccattttcaagctattcttgtgcgtcagccccttgagtagctgtgatttttgtatttttaatagagacgggattttgccgtgttggccagggtagtctcaaactcctggcctcaagtgatatccacccccctcagcctcccaaagtgctgggattataaacgtgagccactgcacccagcccaagctacatatttttattaattccttcagccattccttatatgtttaaaaattataatttttgaattataaagtcagtacatatttattgtagaaatgttttcaaaaataagaaaggcacaaagaagaaaataataatcaagtcaaattttattactcccaactgacttctcttactttgagattttaacagtgcatttatatgcatacgtttttacaactaggtttcattgtcttgttacttgagcatatcctgtgaattttgtaaaaaatatctatctatctatctatctgtctatctatctatctatctatataccgatacatttatttatgctaggaatacatattggggttaaattatatacctgacagctttttctattatgtaatttacatatgtcatatgtgtgtctgtgcatgtgcacacatctagatttatatgtacaaaatattcatctatacatgtatctatacctacatatacccaaatgatactggtgattttctctgaatattgagatattcttcttatcttttttcctttttgtgagaaaataaatatagattgcttatggaattaaagctaattaaaatgtcataaatattatcattccattaagtattcatcttcaatatcacctaatgcctgaaaagttctactattgacatagtagaattactatgtcaatgtactgcttatttaaccaatttcttattgtttaaattttacattgtttccagtttttcactattttatcacacattcttacaggtaaatatttctacacatccctatgcatccccatgtagaaatttcttgagtgttgaaagagaaattgatgggtcaaagggtttcgacatagttaaggttttttgatctatattgtcaagacaccctcccgaaaggatataccaattttatcccaatcagctgtatatgagtgactatttcactgtatcttctgtaacactgggtattacatcattgttttcaaatcttagtaattttgatatgcatcccatatttcaaattcattctgccgtatcctttttaaaatagttcaattttctcacattctttttgcgttttgatgtccagaattgggcatgctaattcaggtgtgatctgacccgcatagagcaataatggactacacctccctctctctgaacacaagacttataataatgcagcccaagcctgcttcagctttattggcagctgacttacactcaacatgccctcagttccttgttgacatgcactgcaaataaatctggtctttcctatcatgtatttgtagaattgatgcttctaaaccaaagtaaagaacgttttgtactaccaaattgtatctgtatatttcaaccctttcttctagtctctcaagatgtacttttttggtcctaatcttctgatctcatagttgcagtattccctgactacaggccctttatgagttgaataaacctgaaaaggagcaggaggtaagaaagggaacaatagtgactgactgcctgctacatgtcaagcaacaggactaaacatttatgtatggtacaatcattgagtacatgtaagactgcaattaagttgatgctgatatccatgtgttaaatatcaataaattgatatcttcagggattgtcttgagaaagattgcacagccagtacagagacggggttggttgggaagtttaactgtggcccttgttattcccagtattccatgctaggtattcccttctttaagacactgacattcatgttggaataaaacttgacagctaatgggcagagaaccctcttcagggtgacatcagactgtgaatgaaaactctttgagaacatgtaattgaataaaagtaaaccatcttgactatactatcaagcagcctacaattgtgccctttggaaaaaaacaaaacaaaacaaaacacacacacacacacacacacacacacacacattttgttcattcaatctgttgggagcccataatgtgcctagaagtggacatgcactgggaagtgaaacagaaatagtttctgccatcagagagcttacatttaattgggaagattgaatattcaaataaacacatgcagaaattaatatacttgtgagaaccagagagttctcactagggaaaacctagcatggaatcctgggaatagaaagacacttaacttcccagcaaactccatctccaaactggctgtgtgaccttgctttgtcaaatatcttgggtgcattcagatatctggtatctgtggtatatccctgatcttcccatgcaacaaaccaacccaaatagaaatgcaatacatctggcataatttttcttcatgaacccatgatggcttctggtgctcccaacttcccttcacatattgaccatgtaaatttgacaaacccacctcattgtacttgagaatcataatcaagattcaatagtgcttcaccatttattagtaagctggataaaatctgtccttccggctgggcatggtgactcacggctgtaatcctagcagtttgggaggccgaggtgggcggatcacttgaggccaggagtttgcagcctggctaacatagtgaaacccccgtctctactaaaaatacaaaaattagctgggcgtggagatacatgcctgtaattccagctactcaagaggctgaggcaggaaaatcgcttgaacctgggaggcagaggttgcagtgagccgagatcttgccactgcactccagcctgggcgacagagggagactctgtctcaaaaaattaattaataaataaataaacaaacacagagggagaccctgtctcaaaaaataaataaataaataaataaaaataaataaataaaaataaatctgtccttcaatagaattttggaaactcttgttcctgccttgatttctccaagattacacccaactctctggttctgaaaacatctcaagattattttagcccctggaagtaatttgattgggtctagagatggaaatcaaggcagccacttcaaagtaaatacttaatacttctgtgttagaattccccttcttataaaatatctttattctccctttcttagttttcaggtttttttcttgatgtgtgacaaatctgacagaatcagaatgaacttagttctttactttcatctggtaataaagtttcagttgtttcatccaataggacaactattttcttattcttattgttccaaaagcaattttaaaagtttgttttacctttgcttattttctttcaaatttgtccaccatgcattgacaattttgaagcctcagcctttccgggagtattctcatgagtttgggctaaattgtttcacctttttggccttttctgtcatcttttagtttcctatacaagtatatcttctccctctatgcttcccaatttccctgctctttttaattgtctgtgattatttgttcagaattttatttttcagaatcttctctgaaatacgcctatttcacgttggaatctgctgccatagaaccaggaagatctatcctctgccattaaaatgttatgtatatatatgttcataaatttttggttataatttttcatcttttgaaataaaaaagttatttcttgctttaataatatccagtgctgtctggatattattttatgaaatgatcattttcctaaattgctgcaagcagtgcaaatttatacggtccttttgggaagcaatttggcaatataaaaaagaaccttaaaaaatgcccatccattttgacctgcttctgggaattcaccataagggacccatcctagacacaggatgggctttatgcactgttatactcattgcaacattatttataaatattggaaaatggaaaatcgccttaatatccaacttgaggggaatggttaatgatgttagaatattaggctttgatgatgatgataaaataatgtagaaaatacttacatttcaatacaagttttaagaaaggggataaaaacacaaatcctatgttaacaaaatgattaatatcaaatacagaggaggttctgcatatggtacagaggagtacgctagtaacagacctatccttgtgcagataataatgatacattctggacaaaatgccaaaaatactacctgagggctcctggaagtaaataaaagcagacatattttggaaagaagttgaaaagtagaggaagtagccagcacaggatgaatttctcatcttcaaggttcttcctttgagggtagtctacacttacagcatagctcagggaacctgaagcagcaggagtaagtttgccattgtctggactgaggacccagtggatggatcccagatcaagtaaagccagcagagagtgagggaagaatcaagaaaaggagagactcagagaaggggagcccacaatctgtgtataatctctgcccatatctccggctgacctctggactacacatgtgaaaggcaggccctgacaggctcagctgaagataataaaacacggagatttgagctgctgctcaccaaaggcaggacagctgaagtccaaccaaattaactgccttcaaaaacaaaacatgagcattaaagaaaaataacaaaacccaagagtcttcataaaataaattcacaattcccaaagttaaatccaaaattactcaacatatggtaaaccaggcaagtttcattcattcccaagggaaaagacaaccagcaaaggccaactctaagatgacccagatgttgaaattagcagacaagaactttaacagcaatagctgtgatcagttgggtaaaggaaatggtgattttaatgactaaaaatgtgaggactattggcaggaaaaaaactatatctacaaatatatgcaccaaatagatattttagaactgaatatgtataaaataaaaaaaaaaacactggatgggcttaattaaatgaagaaaataatcaatggctttgattaacagaacttttccaactccccaatctgagaaacgaagtaagaaaaattaaaccatgtctaaaggacccatgggacaatatcaaacagtctaaatacagataactggagtctcagagagatatagaataataaaaataaagaaataaaggctagaatttaccaaatttgatgtaagatataaattatcaaattcgcaaagctcatggaaaatcaaacatgatttaaacatgggaaaaagaaagagttgcacatcatagtcaaactgctgaaaatgaaatatatatagacacccttgctttagccatttcaataaagcaagaaaaagaaaaagcttaaagtttgaaaggaaggaatgaaactgtattttttaaagatgacataattatttataaaagtaagcacaaagaatatacaaaacaactattagaataaattactttagcatgattgaaatataaatggtaaatatacaaaagttaattgtatttctacatactggcagcaaaagctaaaaaaaaaattcaaaaataattctatttacaatagtgtagaaaaaactctcaaatacttagtaatatgtttaagaaaaggtatgcaatatatcttcaatgaaaacaatgtaacactgtcaagataaagaaaatctaaataaacaaatataccatgtttgcagattgtaatactcaatattgttaagatgctttctccccataaatttaatattgagtaaatgaaatacaagttataatcccaacaaggtttttttttttgttttggtagaaattgacaaggtaattctaaaatttatatgaaagtgcaagtaatccacaatagctaagtaattttatagaagaacaaagttggtagacttaacactgcttgtttttaagatctattataaagctgtagtaaacaagacagtgttgtattggctaaaggataggaatataaatcagtgaaacagaatagagtgttcagaagtatatacaattgatttttgatgtagttgtcaaaggaacgtcttttcaataaatggtgctggaacaactggagagccatatgctaaaaggaatgaacaaaagcccatagttcataccatatacacatattaactcaaaatggattacagaagtaaatgtaaaagataaatctataagctttctaggagaaaacaggagaaacattgttttgaccttggggtaggcaaaggtcatagatagaaaacaaaatgcataaatcataaaagaaaaaaattgagaaactggagtttagaaaaatgaaagatcttcttcttcaaaagacaccactaagaaaaggaaagacaagctacataatcggggaaaataactgtaatacatataatacatatatctgacaaagtatgtttataaagactcttacaacaatacaaggagataagcaaatacaaaatggaaaagatttgaagaaatacctaaaaatatatgaatgctgataagtacatgaaaagatcctcaacctctttagtcatcagggagacataaattatatcacaatgagatacaactgcacaacaattagaatggctaaattttaaaaagatcagtcttaccagtcttgacaaggttttgaagcaagtgaaactctcatttactgcagatgaaaacatgcatcatgtatccactttggaaaaaaaccctatttctcaaaatgttaattctacaacaaccaaataacccagatatcccattcctagttacacaagagaaacaaaaccatatatgttcacataaagacttctgcatgaaagttcacagcagttttatccacagtagcaataagctgcaaccaacccaaatatccaccaactggttggcagataaaatacagcatatttaggccaggcgtggtggctcacacctgcaatcccagcacattgggaggccaagcagggtggatcacctgaggtcagaagttcaagaccagcctggtcaacatggttaaaccccgtctccactaaatatacaaaaattagccaggcatggtggcaggtgcctgtaatcctagctactagggaggctgatgcaggagaatcgcttgaacacaggaggtggaggttgcagtgagccgagatcgcaccattgcgctccagcctgggcaacaagagcaaaacttcgtctcaaaaaacaaaacaaaacaaaacaaaaaaaaaaggatctactgacaggtgtaaataaaggaagaaatttcaaagtctttatgctgaatggaagatgtcagacacaaaaactacatactgtgtgagtccatttaaatgaaattccagaaaagacaaatctaatctatagtaacaaaaagcagatctgtggttgtctgatattgtaggtagaaagaaggatgtactgtaaaaggtcgtcaggaatcttttgggggtgaaggaaatggtcactggtgtatacatctttcaaaactcattgaattgcatactctaaatggatgtgatttcttgtaaacaagttatactttaataaagatcatttttaagttgcatgtagaaaaatataagtaaagcttgaaaaaaatagggcaaaatttatatgttagtagtttttggaggatgaggtacagaacattttcatttttgtttatactttggggaattttagaaactctttttaatgaacattagtcttttttttttttaaaaaaaaagtctatgggatttatcagattaaggccagctttgtgtccctagtcaaatgtgtgactaagatgtgtgttttagtctaatataactcattatcgaatgacactcttattgttggtcagacttacgggcagagcagtaatcccagagggatgagtatcctcacttctcctctgcatttcaggcatgaaattagaacacagacaattcaataatttatcagaaattgtgtttttagcataacaattcttcctgcagctgtctggagaactgaggccctcattgatacactgcattagctctgaattgttttgtatattcaaaattcatgttatatatcaatcatggaatagcaaaaaattattgaattagagtcagaaaacctaagtttgaggcttttttgttgttttgttttgttttttaattctgtgttactgtggtagctttatacatagccctgaaattcttgacatacttcttactgagatacaggatcttcaatacttgaatctgggagggcttgttactgctttgactaaaagaaaatgacagaattgaggctatgtatcttgcatggccaggtcagaaaaggccatgcaatgtcacttagttctcctgggacagaaaccagtcactatccaagaaacctgactactcagagattagcattttggagagcccacatgtaggcacaccagtcaacatccccattggagctcttagccaacaactgcacccatttccagccatgtgagggggccatttttgatgtccagctcagttgagccttcagatgactacagccccacctggtgtttggctacaactatatgagacaccccgaagcaagaactgcccagccaagccctttacgaattcctgacccacaaaactgtgggccaaaggaaaaggttgttgcttttaaccacaaagctttggggtaattttgtatacagcaatcatcaccattaacagtgaccttaagtgagtcacttgagctctctaaactctaagtctcacatctctaaaatgggaatatatctattctaggccgggcaatgtgatggctcacacctgtaatcccagcactttgggaggccgaggcaggtggatcacttgaagtcaggagttcaagaccagcatggccaacatggtgaaaccctgtctctactaaaagtacaaaagttagccaagcatgggggtgcatgcctgtagtcccagttactaaggaggctgaggcaggagaatcacttgaacccaggatgcaaaggttgaggttgcagtaagccgagatcatgccactgtactccagcctgggcgacagagtgagactttgtctcagaaaaacaaaacaaaacaaaatatctattctatactatggtcacaagtcttaagtgagataatacatttaaaaggatattggaaaccttggacaacaaatagctgtagtttcatttattcaaatattgatttgtttactcaacacgttgtttgaatgcctactacatattaagcctgtgcagtaggctaggggtataactgtcaataagagacaattgctggccgggcgcggtggctcacacctgtaatcccagcactttgggaggccaaggcaggaggatcacgaagtcaggagatcgaaactatcctggctaacatggtgaaaacccgtctctactaaaaatacaaaaaattagctgggcgtagtggtgggcgcctgtagtcccagctactcggcaggctgaggcaggagaatggcgtgaacccagaaggcggagcttgcagtgagctgagattgtgccactgcactccagactgggggacagagtgagactccgcctcaaaaaaaaaatgcatatatatatatatattgctcccatccaagagctcacattcagatggaggaaatggtcaagaatccagaaggcagaatgaagtataataaggctacagcataggctaatgcaagagctgtggaacacatggcagggcctcactcctatctcctgggggtagcagaaagaatggtcaggatgtgagattagggttgtgtgtgtagtgaggcatgagaatggaggaaagatgatcacacacaagtgaaacagagattctggcttggctctagctttcagtcagtaagctgaaactagtaaaagaatgtgaacttctctacagagataagggttttcttgtgaacctatgtagattggtcagaacatacttttgaagcatgatggaggcactacagggtctttatcatgtgcatctttctggccacacaagaattaaacaaacacacaatcaggaacaacagattcaactgctaacttgaataatctttgccatttgcttgatcaaagctatagacaatgttaagggaaaagatttcatcaaaagttttttttttttttttaattctgcacaatgctagtctaggagaatggtgattctggaaggcaacagtggaagctttgctccaaagtccttgcaaaactgctctttccaagctaggctacatgggaatgtgcctgcctccatggcctaatagttgtcctgtggccagtagagttatttccaattgttcctaaaaagtctctctgtgtgagtgtgtgtgtgtgttgatggggttttgaggcagttctggcatgagccaaaaaaaaaaaaaaaaaaaaaaaaaaaaaaaggcctttcccattcatcgtttaattaggtctaacaattacataatgtaagcagaatgtcctattactgatgtataaagctttatgcttgggagatgacagtaacagattcacaatcaactcctgggtctctggacccagtgttctttctcatacctcttgtggacaatatggtaataggataatatggtaatatgaatgcttaagcatggggactggtggtgataacagtgaggttttcacagcagtcaagaaatcaggcaagtgaaaaacagagaggggctcatctttgggatggggtacctcagtttccccttagctaggaaaaattcattactctctgtggaagacacatgaaagtttctacacaaacaccaaacttaactagctcagatccaagtggaagggactaaatgtaagttgctatttgcactttttcttttctttcttggacaagtgtagggttttaaacagctctgggagatgggaaaaaagcaaagtggagaaaaaaaaaaagaaaagaacgaagaaagagaaaaaaaaaaaacgcaactccactaatacccaaagttgtgtcaacaggctgttttaggaaagaatgagggactttgttgagagtgggaagggctcccctcacctactgcctcaagatgtgagcagaggctttttctctccctgagctcctgatatggttcctggcacatagtaggagctaacaagtgttggctagaaggaataaatcaagaggagttctcatcagcaccccctaccccatggtactgcagatgttttgatgagatgttttccaatttaatcctgtttgctgagttattagcctgttaatctcaaacataaataatctaccatgtgctgagagtctgactttttctttccctgagctaacaatccccaacagctcttctacgtttctatcccaggagaaacagtatgctttctaagcagccgtcacactccatctttcttcagacatggcactcattcccagggtgaacttcgcaggctctgggggtaagagccacccaaaggcccctgcgtctcatggcagcagggcagaatgtaggggaaaccccttttgaaaatcaccgttatattaaaaaaataaataaataaatcctgacctcttcacaaacccaacgaggaaaaaagtgccaggttgttcaaagggattcactgaccagttataaggaaagctcagtagccgagacctaggattcttgggtctacatcctggttctatcagtgttgtcatgcgggtttaagtaatttaatttccctgttttcttttataaaacaaaagtaattctatatttcccatatggtttggaaagctactattcagatgagaggacatcacatggttaagccagagttcttttttgcccttcctaagacagctactggcccagttgcccccatcctagatctccagtcatgaacttacccagaccaaaacatggtagtcatcactgatccctttttttcctctcctagaggacagccaatccagatctaagtcccattgtctctaccaaaaaatcctaaggtttgatcatttctcatcacctccacagctgcaacattagatgaagctatcatcgtctgtctattttaccacaaaatgggctttctgacactctccaggcttctacatttatattcccaatgcctattccatgcacaaaagttagagaggtcagattataaatgtaaatcaaaccaagtcctttccctgttcactagtctccaatggatgctcatcagctgtaaaacaatactccaaaatccacagctggatcctaattatgtaaccccaggctatttttccatctttttctcttcctgcccttctcactcaccctggtcttcctgcaggccactgaatacattaaccttgttcttgtctcagggtcataatactgttctttctcttcctacaatgttgtttctccacaggtctctgtgcaactgtcacctcctcaagaagccttctctgaccaccctaagatactcccttcctccacctcctcactctatctttttaccctgttttatttttcttcataacatttattgctttctgagatgatgtcatatctacgtttattgcctctctcttacagaagaatagaacctgcaggagttcaggacctttgtctttttatcaccatactctgcattcacttaagtgcccagcattgggtaggcattcaataaatacttgttgaatgaatgaatagataatgcacagaaaaatttaaagctaaacagtagaaagaaaaattgtaaattgcccactctgcctgccctctcaaaacagaaaaggatttacatgcaggtttgaaaacatcttgcaaacacatatacttttggaaactcacctgtttgtttaaatgaggaactctctggggagatgaaagaaatgaattttatttgattaggcatggtgtgctatttcccaattgcttctgagtttgcagaaactggcttcaggttcaaggagtgggaatgcccaagcttcctgtagccaggacaaggaggcccctatcatgtgtgttgaggagaaggtaaactagggtgtggcctcctgatgtcctgaccctctccagcacctccttctccttactctctcctgcatctcacagctttcactccacagcttgcaatcaagcctacccttacaagtgctagaaagaacacatgcaatgattgggagctagatttgagtccaacttcttccttcatgtctgattttcaacaaattattaaacctctctgaatctttttaaatataatttttacattatttgaaatatgagaaagagacactaatcctcacctcaccagccttcctctgatagatgggatttgccagagactgacaaaaatgagggcatcccaatgtgacacaatgtgacacgcatgttatcctgaatttcataggaagatggggtttgactttagaagctttcctatgggtagattttgcaagatggaggtgaataaacaaaatagcactatagcactagaatgtgaaaaggtaattccctcacacagctattatttcatatgaaaggaaatcatatatagatatctctatatatttgtatgtgtgtgtgtgtgtgtgtgtgtgtgtgtatatatatatatatatatatatatatatataccctgagtatatatactcagagattatgtaattgtgaaatgctgaaaaattacaaaatattttggctcctattgggtgtgggggtgggaataaaacactggactggaagaaggtggtggctcattggaaaactttgtcatatctcttagtgaatgactggaaactcaccttcccacacgtgttctgagaacttcctgcacaatgagtcatcacgttatgatggcaagtacttgctcacacctacaacatgcccactttctggacctgaaccagttttcagacttgtattcaccaaccaaaggagagcctgggtgcccatgaggaaggccaccatgccacagtgagtgtatacagtaatgtctcctctaggccttcctcagagggacttatggacttttatttggacaatcatacaccagaggaagaggaacatccagacatttcaaagaccattgagtacaagttgacagtgatagcagagaccccaggcatacttagagtcggggaccaaggggttccaggtaacagaatggagtcacaacctaggtgtagctcacagtgggaggatcctctccctagcccccaaatgtagaattgacacagccatacttggtggctggaagaatcctcctctcattgtttctttggactctgtgttaaaactatcataatggggaaggcaagtggagacatttccattgccacccaagagaggaaactaaaactaaagtctcatcctgtaggtaatggaagcaatcagtgctatacttacagactttaaggatgcatgagtgatggtctgtatcatattcacatttaattcaccagtcttgtcccttcaaaattcagatggattcaggagggtaacagtgagctaatacaaactcaaacaaattgtaggcccaagttttgcagttgtcagatgtagtgtctatgctacaggtaattaatacagcctggggtacacagtatgtgtccattaatatggaaaataagttttttcttttccatctctatctggtaaaattattagaagaagttcacatccacatggggtaggcatcactacacatttgtggtcttgccccagggctttattaactgttctaccctctgtcgttacataatctgaagaacatggaccatctagatatttcacagagtatcacattggtctattatgttggtgcatcactgggctagaggaacaagaaaggaaaaatatgttcaagattttggtaagatatgtgctttagaaggtgtgagataaatcttatgaagaatcgggggttcactacatcagtgaaaattttagagttcagcagtctgtggcatgccataacatcccttgcaaaataaagaataaattactgcatctcacagctcacacctccaggaaggaagcagaatgcttggtaggcctcttttgattctggagacagcaaattacacacttgggaatatttccctgacccattttccaagtagcatggaaggctgccaactctgagttggatcacagaacaggaaaaggtgctgcagcagttaggctgtgatgcaaacaaccctgccatttgttaccatatgacccagtggaccttgtattagtccattctcactctgctataaagaaatatctgagacggactaattcataaagaaaagaggttaaatcatctcattgttctgctggctatacaggtttctgcatctggggaagccacaggaaacttacaatcatggcagaagccgatggggaagccagttcatcttcacatggccagcaggagagagacagggagtgagggtagacgtgctacacactttcaaacaaccagaactcctgataactcactcaccatcttgagaacagcaagggggaaatccgcccccaagatccaataccatcccatcaggcccctcctccaaaactggtcatataatttgacatgggatttgggtgggaatatagagtcaaaccatatcacctgtaggataagagttcctggtgataataaatactgtgtggattgcaagttccaatcaggagacacacaatgtagatctcctgctctcagagtaaggtcatgccttctgcagcagaaagaatgcatttgaaagaaggaactttcccgtgaaagtttcaggtatgctattggatgctatcaagaaaacatgcagccataatctagcagaagtcatgagctggttctgtcagaccctctgagtcatgtggtagagtatgactctcacataagatgagagtggcaaatcacaattaggtccaagcaagctcaagggatacaaataaactgcagtagcagatggcccaggtcccatagcatccaccacaattgcactagtgcctctcactcaggttgcatttagggacacctgggagtggggagggaaaaggataagcttattttgaggagaggtattggctctgtatatggatacaaggatacaagctaaaaataggaccactgctaagcaatgggcagcagtctgaagtgtccacatggtcattgactttgtggggaaagagaagagatttaaggtgtggatgcatgattcgatttactggctaggggcttgacagagaaagacaggacaatcctcccttttgcttgttcaacaccaacttaaaagactttatgaagtcaacagggtggctacggctgtgttcattgctggtggtgggtttatggaggaggaggcaaacagagacactgtggaacttcctccttcacttttagcagttcagacacatgccacaactcagtgctccatgcgaaacatgtcccaattccccggagcctgcttacaaagcttttaaccctcaatgtctttcaaactgactttgatcatccatataaaacagaatagcaccaacacacacagaccagatgaggagcagaaagctccaaaaggggctggaatcagtgacctccaggatacccctggccctgagattactgaagaggaagccaaggatgggaatatcttcctagtgcagtggctctctcacttaatcatgtatcaggatcacctgtaaggccgttaaaacacagatcatcaggctccaccctacagtggcaggggctgagaatttacagttctgtcaagttcccacgggatgctgatgctgcgtgttcaggagctaccctctgagaatcactgtcccagagcaatgaggatgcaaaaacagacctgtgggcaccactccaagctttagcaccctgtgctcaagcagaaggcttccatgagagaggccatatgtgtcacagttaagagactggactttggggttcaattaatctggttcaaatccaggttttgccactgaccatctatttgacattagacaagtgggtcttgcctcgtgagccaaaattttctcacctgtaaaatatggataataataatatatacactatgaaaatattgtgaagtacagttagataacatatgcaaaatcaaaagatgcatggtaagctcttgataaataagaatacaatgacaacacacgatgctagtgttactaccctgtagagtactggctgaatgtaagaggctgtatttctactggctctagcccttattctttaatttaaatattcatctttggagactcagagaggtaattacattaagaggcaagcaaagcaaagagactgtaattgggactgtaactccacccttctccattcctccctacccacctctcctcagccctcttctccaaggtcagtttgtttaaattcggacttggacttcaccaggaattggtttcacattcttcttactcactgtatcaaatgagtatgagcagccatattctttcctctcatctctgcgacatgcctgtctgtgcttttggaggctgatgtcaccacagcagttaactcacatgcctggcacgtagcgtacacccgaacaatatttgttgaattgcatcgaatttataggaattaaggagacaggattttggatacattttcatctctgtggtgcatgaccttggattagccacgcccccttctccaggtctcagtttctcacttgtgaaaacagggatttctcaggcttcttccagcttagctatagcatagtgggcagagatctgaactgggagtcagtaaaccagggttgggggcccagatatgccactaactcatggtaaaaaagttgctttccctctctgtgcctcagttttctcatttgtgttatgggacgatttctacatacccacctcccactccacattcctgaatttcatttaaggccttttgagggttcaaggtcacagcctttaaacagtatttgccataacaggaaaaaagatatgattccttctatcatcttgatgtggccacattttactggaggcttctggaatcttgctggataaaatctcccataacaactcacagcaataatgatcattaatattgtatataatcattaaaataagtagcatcatattactttcaacttaaatggtatcttttagctgagagtctgctgatgctttagcatgacaagtgaaggaaaggaggcactgctgttggagttgctcacttaaatcttccttacatgcattttaaacctaaaggaagagatgggagaagttatttgatatagcattagattttgttttagaagctattgcttcacagaggttgaggctgtagcgagccaccgttgcaccactgcattccagcatgggtgacatagcgagaccctgccaccatgaaaaaaaaaaaaaaaaaagctgcatgtggcatctgtgccaggttctgttactttccagctgtatgattgtggtcaaagtgacacaacctctctgtgtctcagtctactcacctgtgaaggcttctctgcacatttcacagggttcttacaaagatcacctaagatagtaggtgcaaaaatgtgttgtcaactgttaagctctctacaaacacaagacattgccattatggtaataaaaatcaaatggcacatgaatatttcagaagcaaggactaggacagatgtgtaaagtattcccttctaatggggttttataaatacatgctccctcttcttattactaacttcttaataatctctttgcaaagcttgtcttcaaacaccctttgtctcccccatcatttcttcttaacatctcctctctcacacagctatttacttttgaactctgggtggcatttggggagacagttggttagaaaaatatacacatacatattttgtacagagacataaacaaaatgtatccagggcacctcaattctgagccaagatattaaaaaatatatatcttctttgtgatctgttgcagctgctcatattagcaatacttagtctgaaattaggtttaacaactctatccctatatgtagccacaaatatgttcacatgtggcattaatgtggaaagaaaacaaatgaaatatgctcagatgcattttcattctgttaaatcttaaagaaagaaagggttttacaaagccttttggagtctctcttggctaaaaaggaaatccttttgccattaactgctcctgcagagagagcctgctagctgcaagatcatgatgagggtaagcattaattaaatctaactgcgagagaataattatgtacacatatccgtcagggcaggttgtcactatccagtaacaaagttggatacaaactccatcagcagaactgtcaggcggctgttaaaaggatataaatgtgtcccaaaaggatcatttcattgcggcgggggggggaattggattgcaaaggattaatgaggcgaggggtttgtgttttcaattggatgtaaaatgcaaactaagttgtggtatcatcatttaaccttaatgtttagctacatttggatttttaccatgtgatggggacaattagaccttgtacatcaaaccagcatttttccatcatggaattacattaaaggttagttgtttttttcttttaagttaaattgcacaaaagtttacaacaaaatcataaaacccagtttacacagatggcatattcttaataataattaggtcagaaaatgaatatgaatcccaccagagtaattaggatattcagtaaaggaccctttttgttgctgccttatttctgtcaagtttcagtctaagctctgaggcctatgtatgtgcagacatcccacacaggtaatgtgaatgcaagtcttggaggtatgtgctgctaacagacacagctacaatgtagcagaaggtacaggagaactggaagcagtcaggtctaaatttacctccaagctcctggctgtgcaagtttgggcaacttacttcatgtctctgaacatccatttcttttacaaagtaagggttagagaaaggttgttacagtaatacatgtgaaactcattactcttaaaagagtaaagagcacaaaagaaatggccaataattgtggtttcctatcagatatatgtcccaaattagaaagtagaataaacaaaaccatgacactagctttgagattcattcctcctatagtttcatctttgttggaggaattaaagagagtatttccagccaaggcaaaggagtaggaagcctaactggtttcactgcagacttggtggacaactagaatggttagcaccaaagtaatttactccagtgaacgtttaataatctgtaattattatacttgaatgcttgagtgagtgattgattgactgtctgcttctttctccaaatcttgagttacatagaagtgaggacctcatatgtctagatttccattgcagtctcagggctgagcatagtgtcttacactgagtagacattcagctgaaagaataatgaaagtgaggttggagaccctgggtaggtagttaagcttagacagaaggaataggcagggctagaattggggaaatgggaattagtcacagcagccctaaagagcagtttggaaaggtatcatcctacggcaggataattgctctgacttggacttgtatagctctgctgggaccacagatgctgatctaagaatgaggccaaagagtctatcagagatcttagccatcctgggttgctgtagttattggtataattacctactcttgaattctctagatcttgtggagttatttctatgtagttctgcctgaacgcaagatgatttctttgggacccttctccatgttacaatctgtgaaggttgctccgcaacactgcactgaaagggagctcaccagcgtttctcggctaacaccctcggcaggtagcaaggctgatacagatacaggaaggggtcaggtgttacagctgctccctgcaaatctttataactagatcacacataggtaatttggagaaggctctttctctctacggaaaataccctgacaaaagctttatttccatggttttgtaatggcccaatgggttcatcttgtccattgcctagaaaagctaatgcactgagaacagcagatttttacaatagagagtttaattattgcacagccagctaaatggaagactggggtttcattactcaaattacagtctccctgtgatttcagaagttagggttttttttttgttttggttttttttttttttttttttttttttgagacagagtctcactctgttgcccaggctggagtgcagtggcacgatcttggctcactgcaagctccacctcccgggttcacgccattctcctgcttcagcctccccagtatctgggactacacgtgcccgccaccacgcccacctaattttttgtatttttagtagagatggggtttcactgttttagccaggatggtctccatctcctgacctcgtgatccacccgcctcggcctcccaaagtgctgggattacaggcgtgagccaccgctcccggccgggttttttaaagatagtttggtgaacagggagttagggaataagaaacacggattggtttggtcagggaagaaatcatagggagtgaaagctgtcttcttgcactgagtcagttcctgggtgggggctacaagaccagataagccagtttactggtctgtgtggcaacagttagtccatcagaaatcagggtctgacattctggccaacatggtgaaaccctgtctctactaaaagtacaaaaaatagctgggcatgctggtgtgtgcctgtagtcccagctactcaggaggctgaggcaggagaattgcttgaacccgggaggtggaggttgcagtgggccagatcccatcactgcactccagcctggtgacagagtgagacactgtctcaaaaaaaaaaaaaaaaaaaaaaaaaaaaagaaatcaaggtcttaaaaatacttcaaacactaatcttaggttttatgacagcgatgttatctataagggcaattggggaggttaggaatcttgtggcctctgactgcatgacaccagagccataatttctaatcttgtggctaatgtgttaattttacaaaggaggtctgatccccaggcaaggagtgggtttgtatcagaaaggggttgatgccatctttgtttcaaagttaaactataaactaaactcctccatagttagcttggcctatgcctagggttgaacaagggcagcatattagtccattttcagactgctgataaagacatacctgagactgggcaatttacaaaagaaagaggtttaattgaacttacagttccagttggtgtagaagcctcacaatcatggcggaaggcaaggaggagcaagtcccatcttacatggatggcagcaggcaaagagagaatgaggaagatgcaaaagcggaaacccctgataaaactatcagatctcatgagacttattcgctcccatgagaacagtatgggggaaactgcccccatgattcatttatctcccaccaggtccttcctacaacatgtggaaatcacgggagtacaattcaagatgatatttgggtgggcacacagagccaaaacgtatcaggcagcttgaaggttataagcaacatggaattggttaggtcagatttctttcattgtcataatttttgtaaaggtaatttcaatttgaagcagaaatatgagatatatggattgaaggcaaataccacttctttgcattgacagtgaccatttttctagaaatgttctccttaaccacaacctctgccatacccacttcctccctccgttcctcaaaaaacaaacaaaaacataaaatctgcacatgaattgcttctccctatctccaccccttgatgtaaaataaacgactttcagacagataaaaattaaactacatctagccctaaatgttgcagagtcatcactgaaaataaaataaaatattaagaaatggccaaagccagaaaattgaggttataagacatcaagatccataaacagaatttctctcttcttaagaaaattttttaacctctaatttttgagggcagaattttatatatgtccattttattatatctttaatagtgtagttaaatttttctatattattattagtagtagtttctctacttggtctaataggaagatttttgtaaaatgtctcccacttggactatgtattaatcaacattccctgtacttctctcagttttttcatttaagcattttgaaaccatgttgttcctatatgtaagtacaaatttcatttctctcccagtaaatggtttcttttttggttaattaataatactctctattcctaaggatttttccttgttccttcttattgttgtaaaattaattttgccatatgattccatttttttataagccttcatttgattagtattcacaaaatatatatttttcctttccctttccctctgtcaaactttgtgtccttatgctttagaatgatctctgggaaatagtatataactgaattttgtttaatatatcctatcacagggccaggcatggtggcacacgcctgtaatcccagcaatttgggaggccaaggtgagcagatcccttgagctcaggaattcaagactagcctgggcagcatggtgaaaccccatctctaccaaaaatacaaaaaatttaactgggcatagtggcatgcacttgtggtcttgactactcaggaggctgcagtgggaggattgcttgagccctggaggttgtggctgcagtgagctgaaatcatgccactgcactccagcctgggtgacagtaagattgtatctcaacaacaaaaatgaaaataaaaataaaaactatcactgaatcttaatgtgcaaattatatttactgtaatttctgatgctttggggtttattcctatcactttatctttcactttttccttgctcaggctttctctctacttgtatcccaccccacctgaccccctacctggagtcatcatgacaccagcttctgaactcatagcttggctttgcatttcttacaacttatatctgcattccttaagcccggggggcttcctttctttacttttgggatgaatcttaattttttaaaaagtatattttgtccaacatttattttgtgtgtatggaacaggaagaaggctcatgttagctttgtcagccatattgctgaaagtttactacatgacttgcctgttttctttccatgtaggaatgggagcttttgctatacacacacacatacacacatacatacatgtgcaattgcagaattgagatttttctatcaaaatattgaagcccaatatataaacatagaataaaagcttgattaaaaagccctacctattcagccacagttccccttccccttctccctgagcacctatttgtggcatgcttgaaaacatctgctaacggcccaggcagtctatctcatatcctcactatgtttaatcatgtatatctcaatcatgggaaattgtaaagcttctctttgtagtcttctaagtgatttatgcagttgattacagctgaattagaaaagagctgaagttgtcaacttctaactatgtattttgttaaatttcaccaacagtcagtcctaatgtaggtaatagggcctatgtggaccaaaaataaaaccttaagcctgcccaacacactgaatgaatcccctaccacactcaaagccaagagaaacctgaaaagctgaatttcccattatgatgaaaagggcagtcagacatgtctcattatacccctcttcttttggagtttaggcacaactgaccagcattaatattaaaatagagatcaaaagactgacaaaatagatgctgtagcaataagacaccgaattccaacctgactctgatgtagtaacacatgacaagtgaaggaaatcaaaatattttaccccaaaatatattttcttgatgtattttgaaatggccttgcaaaaccatcttttgtggggaaaatttgcatctgtagagaatctccttccctttctaggtctttctgcaaatccaggagaaattaaatgagagtctggtacttttaaggtcttaaaaagtacatttaccatattctctctaaggttactgcctggaggcttcatctacataacaagaaccttggcatctacaacccccattatcttaactcaagcatttacttcaagtctttagataatgtttaactcaaccaattgccaatcagaaaatcttttaatccacctatgacctgtaagtacccctgaaccaatgtataccttacatatatcgatttatgtctttgcctgtaacttcagtctctgtaaaatgtgtgaaaccacactgttactctcaggaacactttctcaggaccccttgggactatcatggtctatagtcactcatattggcttaaaataaacctctttaaatattttatggattttggcttttttaaaacatgattttatatggtcaaatggcataaatagccaatgatttcacaaattagaggacttgaattattccattcctggatctgctagtttctctgtgtgacatcagtgagtccctgtctccatcatttccacatatacaagcagattggatcagacaatgaagcagaatgatgatgtgtaccttttgggctcaatccaaaaaaccttgcagctcctacttctgctgtttttggatctcccaggcatgtgaaccaggctgggatagctggctagccagaggtgcatgagatgtcagctgaacctaccccacccagaccagaactaaccacctggagccaagcccaaatgtttttattgaattaagtgctaaataaatgggtgctattttagttcactacgttttaggttgttttattatgcaacaatgctaacatagcattattaccattctactgaaagaaatatggtagagttgtatccctaggccccaccaggatctggtcgtgagccttccgctaaggctgctttcagttgcctctccatcctccaggccagatagaattgactgagagccccctgatgtatttcagatggacaagaaaaagctcctgaaggagacatacactttcaggaacacaaacttctctgaaagacacatcagggaagatttatggaggcagttgtgtgctctgactgctgatcagctttcttatgtctcagtacaatacaacctgtgggtcaccgggttggtggtggtactctccccggctgcacctcttagaagagacctgaggtcaacagacagaaagccagagactgagggaaaaggtttcctaatcaaagatacatgccatttcttatctttgaagatgccagggtgccgattccaggatgcaacaaatctacagcatgctttaaagaaggatttccataagcatcctagcatattctcacgacagtcctggacaaaagaatggcagatattctcacatccccagatactggggatgaataatatccccaggatattaaggatattaagcagtttctctaaagatcctccctgagtatccattgcacttagggcagggttggggttcaaaccagaagtttctgactccaaattctgaattgtttagtgtacaacaatatttttcaattgtatgtatcatcaaagactatttgagttgggggagacctgtggaaattatctagcccatcacctttgctttccaaattaacaacaacaaagattcattaggtgcttaccatgcttagtacagcctgcggagcactttacaaacattaactaattctcccagcctccctgtgaggtgactgattgtatgatttgtagattaggtaatggagatttgatgcataagtcatttcccaaagttgagccagtcagtggcagagctaggatgtgaatccacatctgtctgactccagaccctgagcacactgccacaatgccatatagccttttagatggggacactgaggcccagagagtggaaggtcttgtccaagatcatgaagccagtttgattaattgtccattaattcatcaattattgaggatctgctatttgtcaggaagcaggctagccaatgggaacacaggcatgacctagatatagttgtgcacttgagagtaattaagggagaagataagaagtgactataaattacttgaataaaagatagtaaatgacaaatatctcagggaagatagtgaagaggttgtcaaagtttggaggaggtatgcacgactttcatttgggaaaaatttgaaaattcttcacagagaaaatggtttaaaggtcttgtttgaaagaagagtagaatttgcatattggcaatgggaaagaggaagaagttcaagctgcaaaaagcgcatagaggtggaggtaaaaggagttatttcatcatagactcagggctggtctccaggtagttgtgtctatccagtcctccttgtaacccctataactatctcatggtttaagtggaacctcattttgatgatgcaatgtcaaaacttcctttgtcaaaaggggcggtaaacctaaatcccacccaaaaatccttggtaggaagggaaggctgctaagaaggacaaagtgtagggaagcaaagatggggaccaaagaaacaaaggaagatcaatcctgggactacctgttcaatatttaagcagagcaacgacccattaaggcaactaatttaaagtcgctaatgtttctattttcttccaactaattgaataattcatgaccagttactaatgaaaattatatatatatatatatatatatatatatacacacacacacacacacacacacacacacacacacacacacacgcctgtgttccagggacagtgtcccacagtaaaagcacattgaaacattgaagcttatctatcaagaaggataaaggagccagaatttgcttctcctcccaactgtgggatgctgctgggaaatgtgtgagcaagatccaaagatccagggtctgattttgatggaggattttgtggcttcccatcttcccactggcacctgcctggatcacattttcccccagatattcccgttaccccctgcacagcttcatccctatgtgtatttgcatattttctttattctaccagcaatgtcttcccaaactttctctttatttaatgcattacttaggattacctgctctgtgaagccttctttaattattcccccagtttagtaaataccccaagccagcccacaccaccttcatgtatccattgtggtgcagatacgtaatgccctgcttccttcaataaatggtgaagtactggtaggccgagatctagttggcatataccacacacatgtggcaaactaaaaacattgagagtggatgtcttaaaaaatgcacagagcactatccagtgacgtaacactgtgggctcctgaggacatgggactggctccctggggttagttaaaagctgaggggacagtgctgattcattcttagctcagagagggagatgcctcaccttctagagcctcatagctcctgaacaccctcacagcagcactgatgacacagaaacactgccaatgcaagagaagctgcacgtacttccttccaggatctagactaggtaggtataatttcacagctcaaagatcttagttgtggtagctaagagtagagctcaagtcatctgggaatttaaatgtgggctctgaattcatagctccactatgtactagttgagtaaacttagacaagtgactgaaactgtgtaagcttgagtttccttctttgttgaatggggataattatagtacttaccttatgggttattgggaagttttaaataagataaaatgtgtgatgggcaaggtgcctagaacataccaaatgctcagtagatggtaggctgcactgcatcccattaaccgtttgcatactgtgagctcccagctacctccctttatctatttacccgtctccatccattcattaatttattcatatattcttccattaaaccaattactatcccaagccagttccctgttaggcattcattctacagacagacataaatcactgttttttccatcatgggactgtgagagctgaagaaggtgacagatgtatttacgacagactgcaataagggcagtgataaaaaacagtactggggctatgagtgctcagagaaaagagtggcttgctgggctgcggctgcggtaggggctgagaaaatgcttcacagagcagatgctgaggctggattttgaagataaacagcaattttttgcctggagagaaagggtggggaggaggaaagggcctttcaggaagaatatgatcagcactcggacctagaaagcaaggcatactgggggaagggagaaatggcccatgtgctggaggctgtaggacacaatgggttgggggtcaggagtagacagaggcagggtacagcccaggctaggagggagccttgtgtagcaagtgatggcaacttttaatcccattaaacaatatgcccttcatcctattggttcttgcttctataacaaggtaaatgtatctctgtgaggtaataataccgataaaaataagactaataatcatagcaatgatcagaataataaataacacaataaaagagcacatatgttcagcatgcaaatatgtctggctctgtgctaaatgctttactgggattatcttattctggcctatggaaatcctttgaagatggtagcattctcacccccttatagttagttaaatcatggttcttcttcctgggacatcaatattgtatgaggaattgagcaagtgttaaattaattaactgaaaaatactataacttaaactaaaataaacatgcatatactatgaaataaaatggcatgatcttttaaaagatgaacctgaaatgtgaactttatgacagattcttttgagcacagctgcagaccctctgggggtaagttcattttcatatgcctttaagaagacttcatttcaaaagctcaagaggcccccagtgcaagtgacagaaaatcaggacaatgttctaggtgggggaggaacatggccaaatttactgtgttttcaaatgatcacccagctgtcagggtagagcatgcatttatcggtgccaacgctgctgcaggaatctggatgagggacaatgagacctcaaccaagctagaggcagtggctcaggaaggggaagatggatttatgagacgctgcaggccaatgggcaggacttggatgacagtgattgtactagctattccttattgagggttgaacgtgggacaggcactgggctaagcatctcttgggtattaattcacaacccacatgtgatgttggtattattagcactatttccagaagggaaaacagagctcttattaattagcttaagagcatttagttagtcaatggtggaattaaatttcaaacacaaagtcccgctttcaaaaaccgctacctaaactaaataaacctatggaatttcttctgtacatccaaagaaatcttcctctgctttatttgaatgccactgtcctttatactgcccataagatgctggggagtggctccttaatagcagcctcataaaaccccagcactaacatgaagtcagaagttcaaacctccactatccttcctctgtctggctaagaatgatgcacttcagcctccaccaggcctctcaggaagaaggcatagctacaaaaataccttggagctgcttttaaccatgtgctcaattccatggcactggttctcggctacccattccatcttctggaaactagtgggcaccgtggcccggggatgaggcctaaggaagcagaaagagggcaggtgctcccaatctggaccaggcagcccacggcaacctcaatggcaggagagggcagaaacagtgaaagacagaggattcagaccatcctatttgggattttggaggctaatggagcatttccaaaattctgttcctatagatgcttctgttcagcaagtcattaataaatgttccaatgggagaaataagagtttgcagtcaacatagtatcaatacattgagttaaacaaagcagcctagctttctgtactgcaggacttctcagagtttttaatagactaagattcattcaagaatcttcaagagaaagagggagggtggagaatttccaaacttttttttttttaatcatgaaattcttttgtccaaggaaatcttgatgggctgtcttgggtaagtttggaagtatagggctgacatatactgtccttactcttctcctgcagaaattgtatcccatggtagcagcaaaatcacaagcatactgtgattaagctgttttggaaattgctttaatagcatccacttgagcacatttactgtgctacttgtcagtgagtctaagggggaaatagaattctctgggcgttggtaccaggaggatttggtttatcacagattcctcttgcaccatcaatatgagagctataaagctgagccattttccagtgatctttgatgttaatacgctcatttactcaactaatatttattaagccatttctatgtgttagatttataaatatgaatcttatattttagagaggaggatagtagacaagcaaaaatttaaaattttagtctgaactactactgtggaagaagttaaaaaaggagggtgacgtaagagatagtagcaggttggggactgaaaggagcaaaactgtagattgggtagtcatggaagttggtttttaggagctgacatttgaaaggcgagaaggggctggctaggagagcagctgggggaaagaaagaggcatggcaaggagaaggaggaacaagttctcagatgctaaagaaggaaccgtttgctgtgttggtgaaacgtgaaggaagccagtttggctggagcacaaggaagtgcagagcaaatgatgttcgaaaagagggcaggagccagagccagatccgcaagccaaggtgcagagcttggatcatagtctaagaataacagaaaactgtcaaaggattttaagcaggggaggggctttctctggtttatctttctaaaagattgctttggtagttttgaggagactgaatgcaaggagagtatagttgtaaggagcagttaataaatgacagtggtcatgatggtgacaaagaggaaggacagatatggaagagatacaaataaatttcttcatgcatagttttctgagaccccatctaacttgtaaattaacttaaaacagacttttattaataatctgactatgaaattcttctctaagaggggaaacattttaaagtaagtggcaagttttatgcaaaaatactttctatgtaacattgtttatcatgatgaaatattaggagcagcccaaatgcctaatagtaggggcttagttaagaaaattatgatgcataaaaataatatttttgaaaaattcattgacataaaaatgtttagaatgtgatgttaaaaaatgaattcaggttggtaatgaagggaggaaaggctatagacttggagtcaagagtgtttatggaatatgtatgtgtggagaggacttaggagggggatttctggtgaatgatacagaagtaaagatgaataggtaaagctatacgaaatttcaagtaaccctaaatgccttacccagaacaaacataagattgcatgtattcattccctgatgcatgccatctgaactttccaaggtggtctacattcagccttttatcaggtcttcacaataatcttctgatgtagggcttggcatcctcattttacagaagaggaaactgaagttcagggagaaccaatgatacttccaaagtcatgcaagttaaaactgacttgggctgggattagcactcagacctgtctgactttaaggtgactgctctgtatcactacaaaatggtttaaacctggggtttcccatatgagttccaaaaacgaattccatcattttcttctgcctcaatttgtgatctgacagcttaacatgtagagcttggttttttacaggattcaagattttacaagattaagaattagacatcctctcaacagatagcaaacatctactatgtgtcaggcactgatttaggccaggaatgtaaaataataagacaatccctaccttcaaataactctctgtctagctaaggaaagagccagacaaaagacaatgatatcacacaaaaatgaatctagtgcttaatacatgtataaaggaaagctgggaggattcagtgaattgtgactgtgacaatcaacaacgtcttcatagaaatgtgccatgcatgttaagcttgaaaagacaggtagaatttcattagtgtatcaggttggtgcaaaagtaatagcaccaacataatagtacatagtcgttaagttaaaaggtttgagactcagactgccaggttctccctggccccaccacttactagaatgtcccctcagacagattacaatagctgtttgtaccttagtgaaattatctgtaaaatgggaattaccactgtacctgcttcatagggttgctgtgaggatcaaatgacataagatgcatatatcatttaagctgtttcttggaataagttaagagtcaataacccttaggggccagagaggtggtttcatgcagagagcatggcatgggaaacagcactgaggacagagcacaacaatctaggaaagacagtggagaatagagctctgtgtggctttgagtgtcatgttcatagcctgaacatgtgtgaaggtgctagataaccactgaagctgtgggaaaagggggatgacctgatcagagccaagttacaggaaatggagaagtgagaggcaagaagaggagactactagtttttctatctactcagctagagactactgagtagatagaaaaaaaaatggtttggaaattaagcagtgacaagttgatttccttcatatacgaagtcacatagatggtagaagaagaaagaagggatgaagagaaggaggaggaggaagagaagtaggaggagatgaagatgaaggaggaagagatgtagaaggagaaagaggaggaggaggaagaggaggaggaaaaggaggaggaggggaggagagaagagaagagaaggagaaggagaaggagaagaagcagcagcagaggaaaaggagcaggaagaaaatatctgctttttaataaatgctgggttaggcactgtgctgagttattcttacaaccctgtgagacaggagtggcttggagaagtagagtgatttgccctgagtgacatagctaggtagcagcagaaacaaaagttgaattaattctatctaatttacaataccactcttgatcattctgttattcagcctgctaaaaagtaggcgcagacccctgtttctggctcccagactgaggatgtctcctactagaatgttctgccactttgtactctctgaccggcaacaacttaaagaacatctactttgcagaggtcctggtgctacacactttccatatatagttgctaatctcaatcactgtaaaatttatactatccattctcattctcagttgaggcacctggggctcagagaggttagctctgggtgtagggagcataggtctgcagcctccaaggggatttatcagggagaaagtggcacaagttttatgagcacagggaagcaagggaagaatgcacagatctccctagcatctttggaatcagaggacaaccttctgacttcctggccagatgtgccaggagggcctacctcgagacttgctcctccgcttcctcttccctgccgatgtgctgcgcaggggtggttgcagctgaccgatctcgatgggcgtgttagcgcggaaactctccttgaacttctgcatcagggactccactgtctcctgagtcgcctcagctgctgctataaggtagcaatggggctgaggttagggcttgagcccaccctcagcacctagagcactggggctgaagttagggcttgagcccaccttcagcccctagagcactagacctggccaccctaattccttgaaactccctccctgacccattgaagatatagaatcaaaaccttgcagtctaactgcagatgtatctgttggattacatacttatgtattcaacatttactacgttccaggtactgctctaggcccttgagactagagggcttggtcgtgaaatgtgagacacaattcattattcaagtaattcttagttcagtaggagacatatccagacaattctaacattgtgcaatatttttgcaatagaagagtacaaaattccaaaggatcactgaaaagggtcatcacacccatctgagaatcaaaataggcttccagaaggaggcaatatttaggatgagaccttaaagatgagtaagaattagtaaagaaagcaggatcagggtgaggttggacagagcagagaagacagcgtcctggatggaaggagaagcatgtgtgatgatctgaaacgagaaggagcacggatgcttgagcattggaaagtaatttatggtagttacaagagagcttgcaaagaggaggcttatgggagatgagattggagtgataaagacatctggtaggccacatttaggagtataaattttatcctaatggcaaaaggtatcaccaaaaggttttaaacagaaaatctatgtgttcaaattaaatcactttgaaaacaatcactaactaaagtatggagaatgcaaactgaaggaggaaaggaggcctggactgaggctttggaagtagccagtcaaaggcaatggtggtctgaaccagggcagtggcagcgaaggtgacacaatatcttaggagacacaaccacagtactgtggatatgtcgatcacttagcaacatatacccattttattgaggggatgttgaagccccaaaacacaatatatgtcttactccaagataggaaatggcagagtcaagccttctaacaccttgtccaatattccgtttgcaccaataccttccaatgaattgttagtagccacatttccaaaaaagtttcaaagttgaaactggtagaaagttcagtacatggagaaagtaaggtcagaagggcagagagaaaaagttggaagataaaaggaaaaaaataacagaaaagcttgagaaggaaggaggcaacataaaaggcaagaagagaaaaccaaaaagaagaaaagaaaaattgctgaatagcctcagtgcctttgttctgagaaattcccaaagacagccctgactttgaaatcttcaaactcatccctccctccatctgtgtctccagaggctgggaaatttcttcttcagtttgagctacctgctgtctgatgccaagagatgggatgtgccaacaatttctgtttctttgaaggggcttcatcagactagacaaagaaggctcctgaacaacccagtacccatttctaaggcgctcctgttttctcagggaagcttatcaggttagacagatgtgtctgcagagtaagtcagacctagagggcttgttctggtattgggttctgtgagaagtcccatcttgagggttatagggaaaaggtatgattgctaaggtaaaaagacaattgacaatacaaatgaatcatgtggtggcattggtttcctcatctgtctcccttgctatctctctccacagatatcttaattaggtgtacttgaagaaaccaagaagattccagacatggggtcccttcttcaagcctgggatgaagaatccttcagctatagcctgcagtatgactctgagaagcaatgtcatgccaagttttgattccgtaaacccagagagaaaagtgctttgcccaatagatgggctatactttggtcaaaagtccagaataagccacagtttggaatcctcgaagggaatgacccacacaggatctgtcaatattcattcattcattcatttctccacttattcattgattcattcattcaacagaatttacagaaaaaaacattacataccaatgctgagaaccaaagacatagcttagcttgggctaccataacaaaatatcatagtctggttgtcttaaacaacagacatttatttttttcacagttatggaggctgaaagtccaacatcagggtgccatggttttggtgagatttctcttcctggcttacagatggccaccttctcctccctgtgtcctcactcggtgggggagcagggaaagagagagagaaagagagagagaaaaaaaaaacctctcccttcctcttttgataaggccaaagttcaatcagatcagggccccttcttatgacctcatttaactttaattacctcccaaagatcctatctccagacacagtcagccacggattgaattgtgttccctccttccccaatttatatgttggagccttaactcccagtgtgactgtatttggaggtgagggttttagcaggtaattaaggttagatgaagtcataagagtgggatcccaatctgataggataggtggccttataaacagggtaagaaagaaagaccccactctctttctatggacacagactgagggaaggctgtgagaggacacagtgaggggtggcatctgcaggccaggaagagggccctcaccagaactcgaacatgctagcaccttgatcttgacttttcagcctccagaagtacgagaaaataaatttctctcgtttaaggcacccagtctacaggttaagcttccctaatccgaaaatctgaaatccgaaatgttccaaaatctgaaacattttgagcatggacatgatgtttgaatgttattctctaaggcaagcttgtccaacctgcggcccaggggccacaggcagcccaggacagctttgaatgcagcccaatgcaaattcataaacttccataaaacattatgagatttgaatttcttttgctcagaaggtagagaatgattgataagggaaaaggagggattaaggatgactcctgggtctcctggcttgcacagatacggatgacagttcctcagtaagaggaggaacactgtaagagatgacatttgagaggagtgaacactagtttttttttttttttttttttttttttttttttttttttgagatggagtctcgctctgtcacccaggctggagtgcagtggcgtgatctcagctcactgtaacctctgcctcctgggttcaagcaattcttatgccccagcctcccgagtagctgggattataggcatgcaccaccatgcctatactatatataggatttttagtagaggtggggtttcattatgttggccaggctggtctcaaactcctgaccacaagtgattggcctgcctcagcctctcaaagtgttgggattacaggcatgacccactacgcctggctctttttttttaaaaacttttattttagactcaggggtacaagtacaggtttgttacgtaggtaaactgtgtgtcatgggaggttggtgtgcagagtattttatcacccaggtaataagcatagtacttgatagggagtttttctatatggaaacctcagaatgtctttgagacatctaagtggagatgctgggtagacagtgagttatgtggatcacacatgcacaggagagagctggacgctctggagactcaatacccgcattccttggaaaaggtagacagtgaatgtgggtagtggctgagaacatgagcttctgtgctggcagagcagaggcagcagaacctgtactcattcctagcttgtgctggctgttctccatttacactcccagatccacccttcaccctctgggctgtgtcacccgctccttgttagatggctactagttgggtttggcccgtgggatgccccagaaagatatgggaggaatttgaaggtatttctttccttgttcctttcctgtttcagtaccatgtttctgacagagactgagattctcaacaattacagctttctgcccagtgtcccttttccacagtcccagttctcacagggtccaataaaaccatgtctccctgccttttcagttctaggaatcagtagtggcttcctgacattcttgtcctggtaccttgaaattcctatgttgattctttttactttgcctacacctctataaatagccacttcattgaattctttttaaaaaaatcccatttgaagatgtgttctttgtctagctgggaccttgactgatatatcattcagcttccctctcttttttttcatggctctgacattcagcaattcctaaaggtcagcctctttccattttgcaatttctgtcttctttcttctaagctgatacagatttgagtggctgggaaaagaaggcacacagagaaggaaggggtgatcccctgagctgcaagggtttctaatccccactgtagcaaatcccatccatctgtttggctgctcttgcctcagtgacagtgccaagagcccaggcagacttagagggggaagtgctttgcaaacctctccatggccaatttcatcctgcatacaactccccctatccctgatccctcccgaccccattcagcagctctatcgatatcagtatatcaagttgtccaaacaagccacattacctcctggtacccgctgagctctgactccccagagcggcaaaatgctcacccatcgcctggatgaatgcaacagatgctgcttgatctgagcatcgcggcaggcccaggaaagggagggagaggaggggaacactgcctctttctaattgacatataagagattgtcaagcttaatggtaataaaccactggggcctgaggaagaaagccctggtccccaagccaagctagagagagaggacaggaaaggaaaagacaggatggaagaggagagaaaaaaaaaaaaaaaacaagaataaaagagataactgtgctcagtaataaagaagagaagacaagaaagagggggtctaagatgagtgggaagaagcagagaggcagaacacagaagggaaggactaaaaaggacaggcgaggagacatggaaaagaaaacaagaaaaagaagaaggcatagaagttcatggtgagggatacaagactacaaactgggttcagtgtataccgctcgggcaatgagtgcaccaaaatcccacagattaccattaaagaatttactcatgtaatgtaataccacctgttctatgagaaaaaaaattaaaaggatagaaggactaagttctagtgttctatagtgctgtagggtgactgtagtaaacaataatttattgtattttttcaaatagctagaagagaggattttgaatgttcctaactcaaagaaatgaccaagctttgaggtgatggatatgctaattaccctaatttgatcattgcacattatgagcatatatcaaaatatcataccgtaccccataagtctgtacaattattatgtgttcattaatattatttttaaaaataagggataaaagggggtggaccctgagtcattttgcaaaggcataagtgttgtatgggtttccagataccaggcaagccttagcttctaccctggagaagaggcactacacattatgtctacactgatactcaaaaactgtacacttaaactgtatatttaaactgtcatcctcaagacaagcctggccaacatgatgaaaccccatctctatttaaaatgcaaaaattagctgggtttgatgcaggcctgtaatcccagatattcaggtagctgaggcagagaatcgcttgaacctgggaggtggaggttgcagtgagctgagatcacgccattgcactccagtctgggtgaaagagtgagactctgactcaaaacacacacacacacacacacacacacccccgttatccaccgttctcttcccccacgcaaccacccaggacgttccaccgatgaaacgcatatgggtttgagttgaagttccagtatcactttgctcgccctcttcaattttttcagacatcatcagtctgtgacataagaaaattcacatttcttgagcaccaactttttgctaggtagggagcctggtatttccttatggtttctcacttgttccccctaacaacctggaaagttaagtattaataatttctgttcagagatgaggatagcaagactcagaaatgttacatggtttttccaggtcatgcagcttagggacgatagaactgggatttggactcaggttatggtgactccaatgctctggccttatctgttgctgcactctataagtactccctctctggttggctggagatgggtatgttaatcttggagtttggatgtgacatttctgggcctggatggtggctctgatagcttagctcctcttcagatcatctaggcaaagagccctaggaaatctggtgctgcctgaaaccagtgagtggcttgacttgattggagattagcctgttatgccagtggacccttgctcaagactgtccaccatggaggttccagggttgacccatgtctcactgcagaactgtactaagagaaccaagaagcaaatggacattgaccatattgcctagtgcaggtgagaaatctcactcgagttccagtatcaactctccatgtgcatggccttgagttacttctttcacttttgcaacccctggtatcctcctctgtaaatgtctgcagggttcttgggacgattaaatgtaattatgtacaaaaaatgtctaacagagcttctagaacatagtaaatgctcaagaaagagtagtcattactcatctttctctcactaacctgtcagcttcatgacatttcatttaactcattctttctcattcattttgaaatttttggtgtcataaaatagccactttgcaaactttcttagaaattatacattccccctttcattcaaatgtgaaaatagaggcaccaagagataaactcatcataaagttagcagcagaccaaggtctagcactcaaatctcctattccactactcctccctgctttcccaagttttaggataattttaacctcagatctgatagtcaattttgtgcgccaatttactaaaccatgatatccaggtatttggccaaacattattctagacatatctgtgaagattttttatctatatttttttagatgacataaacatttgaatcaataaaattggagtaaagcagaacattctccatactgtgcatgagcctcatccactcaagtgaacaccttgatggaagaaagactaacctctctgagttagaggaatatgctacctttggacttgagccgcaatatcaactcttccttgggtctttagcttgctggcctaccttacagatctggaacttgccagcctccacaatgacatgaaccagtttctttcttttttttttaattttaaatttatttttatttttattttttttgagacggagtctcactccattgcccaagctggagtgcaatggcatgatctcagctcactgcaaccactgcctcccaggttcaagtgattctcgtgcctcagactcccgagtagctgggattataggcatgtaccaccatgtccggctaatttttgtatttttagtagagacagggtttcaccatgttggccgggctggtctcgaactcttgacctcgtgatccacctgcctcagcctctcaaagtgctgggattacaggcatgagccactacacctggcctgaaccagtttcttaaaataaatctctggttagatagacagatgaaaggaaatagaaggatagagaatacatataactaatagggtgttgtgtgtgtttgtgtgtgtgtgtgtgtttgtgtgtgtgtgtgtatgtgttcatgtcttcttggttctgtttctctaaagaactctgaccaatgcaacctcagtttgtgtcctcgggctttggactttgcacagtcaaatgccaggactggggacaaggtgataagagaagacatcttagtcctaaggtacacctaagctgggaagacccaacataaatgcaaaaaaaaccatccaatttggaaattgtgagagtccattcattgcatacaatattccatcttatataggagtcaccttttcctgaaaatactaagaaagaaaacaacaagcaactagcgttccttaggcagatgagaatgcttcatgactagaataaatttaaaacccaagcacacatttttaaaaaatggctccctctttccaactctcaggggtaaaaattgatggattgaattttctctcattttagtttttcctcctgcacattttcttaaacctttggtgcctggcatagcttatcttcaagcaagcgtctgcagacaagacaaatgaacaaaaaggagcaaatataaattggaaaacttgggaatagccttttcttatatacaagatcttgggcctgtcagttaatactgcagacttgtagggtggtcatgatttctgctaggagaactgcattgagtttgaatgatggaattaaatttagcgatatttttctctgttctgttaaaaacacaataccttccaggttctctggagctggcttcacagtccctagccagaacacagatggtctctaagattccctccggttccatcatcctgtgttcctaaatgtaaatgaatgtgctttcatgaagatgaatgcaataaatacaattgcattcttcagtacgcaaaacactttcacctccctcaactaatgttatccttacaaactgaacttccacgttacagagaccagaaaggtaatggacatcccaaaggttgggctggagttgatactataggcccacaaatcctttttgaggaaaaaagggtcaagtaagtagacatcttcggtctaaggcttctgggtcacttcattaccaccttgatagcaatgtgcaggaagcgaaggctttgaaatcaaccacagtctcttaccagctgtgagacttgggcaaataacttaacactcagagtctcagctctcctaactgttaaaatgaggcttgcaattccaaatctaataagctggtttaggattaactgagatgctaaatgcatatcagagtgtctgatacagagtaagcacattttttaagagacaagacctcattctgtcacccagactggagtgcagtggtgcagtcatatagcttactgcagccttgaacatctggcctcaagtgatcttcctgtcccagactcctgagtaactgggactataggtgcatatcaccacgcctggataattttgtttttaaaattatttgtagagattgggcctcactatattgcccaggttggtcttgaactcctggcctcaagtaatccctcactcagcctcccaaaacactgggaatgcgggtgtgagccaccacacctagtcagagaatgagtacatttttattgtgccaagaaaacatttttaaaaagagatggagtctccctacgttgcttaggatagactcaaaccccttggctcaaggggtcctcccacttcagcctcttgagtatctgagactagagacatgccaccatgccgtgctattgacaaaagaaaaaaaaacaagtaacaaaaatcttaaaccattagtcatatagtcatagcaaatccagattttctgctcagcatggacagtggaatccaataatccaatgagaatcagagtcactagccaaattcctccctcccagatctatcctgtccatgacttcagaggaaggccacatcatatggctcagaactccgtgggagtagagccacctataccttacaatggagttcttcattcaataccgttagtggatgctgtatccagggccaggcactggggacacagtgataaaatgaacactgtccctttttaaaacaggacactgtttagtggaagagggaggtaaagataatgaaaacagagtgtgctaaatgcttaggtagagagcaaagcatcataatactgagaacctgtcttctaactccttttgcaaggagaaaggctatgagaaatttccagagaaagtaccaattgctcagagccttaaataaaggatgtggaacttgggaaagatgacagaaagagtattatgagcaagagaaaggggcaagggttatacagaaagttccacacactttggttcccctggagcttaaagtgagagacaattttgttaccaagagaattcatcttcaagctaggaaagagagcctgctgttttctacccaatcttacttctcttccaagaccctcatttaaaaattccacttcttttcatagccctactgcctggccccactctcctttctgacatctgttactgttatcccagataccctgggtgcagcgagagcagagtgtagggatctggacagacttgggcttgagccttcattatatctcgaactcattatgtgactttgggtaagttccttaaattctttaagcctcagttccttctctgaaaaatgttgagcataaatctccctcaagaattgtggggtttcttcttttggtagtgctaaaattcaatgtaataatataagcaaagtgcttaacacactacccaaactggattaagcaatcaactaattaaagcatttattatcattattgttatccggcttaacctagataagcctgcggagggtcttgcacagagtcaaagctcaataaatactaagttctccatttccctttggggtaaccgatcgcctttgactcactgttgtcctttcatgttcaaattttactatccttcctggatcctgtaacattcagggttttcatctccattctacttcatccagtcccattcatggttacaccttggatcttgccataatttggaatctggatgtggctgcaacattaattccaaagacacagcttctgctcatggtcttctgtctgctctcatatcttgctctttcatgcttatcaagtttctgctttgacctccaaaagatcaccaggtcctgaatttaggcatattgtgtcaaacacttgggaaaatataaaactgttgctgacagatttatattaaactgttacatgccagaaaaaattgtttttccagcagctagttggaagaaaggggagaaccccactctcttacttttaattccttcctttcttgaaattttacttcctccaagtttcacttcttccctaagaacttgaagttctcaggtgatttgttaccaggattcatctaaatgtaccattcctattttccaagtctatctcagtattcaatcacaataacactaataacatttactgtttatggagtgtttactacatgacagttattagtttaaggtaaatacagccatcattttatgtaatcctcataatgtccatggtacatggaagtatctgcctcatttttttacccccaatttcaaatccacattgttgctgcctcagtatagatagagtacacttcattgccccttgacttgggcttggctgtgtgacttgctttggtgaatggtatgtgtagggaactcaggatgtgctagttatgagcctgggcttcaagaagcatcacatatttctactcccacacttgcatctgacaccaccaagaggaaggcttgtcgcagctagtgtgctagatgaagaaggaagaatgactcagggtagactcacagctctgcagcatggagcagagtcaccttaactcctacagcctgggtccttgaccctagcaaatctgtaaatgatgagcaatgcctgtgagatgagaacaacacttcattctatcctcctttctatcctcagaactaatcaatatttattatttcaggacactaagattctatagttgtttgttacgtagcattgttgtggcagtgactgactgaaacacaacccttcaagatacatatcattatctctatcttataaatgcgtgagtgaggcaaacagagcttaattaatttttcaagggtcatacacaaccttagaatagcagaactgcataaatatcctcaaatactactttagggcttattttgcagtgggaacaataaacatgatttaataaattgacttccatacagaagagggtgaaataaatggtcctcctcacagccacctttcctttagaccacattagtgataattgtgaggatgatccaagaattgacaatcacctgaaactagaggtatccctcgtcagtggcattagagactgttaacacatccattcacagtttttagagttgagctatgcttgccgaatgaatgaacacatgtttccaggcatgtatgaccaggcactcaatgaagggtataaaaatatgcattgtgacaagagtatattacttacccataatatggctgggaatggggatgaggagagagcagaatgtggaatctgtataaattctcactacttcaactgtcagattttccacccatcttctttgaaactaaggcaaatcttcccagtgcaatagggtggttataaaattaaacatatgtaagtcaactataacgaatggcagggatgttagagcaaaattaatgcagccacattataaatatgtcctatttctcaatattaaactcttaaaaatagactggctaaatatatagacaataatggattgaggctaagttggcgttactatgaggcttgggattttccatttaatggcttataatttccatttcccatttctacatgacagtaagagcaggctggcttcattattcatgattacatgccgtcaccatcaacaaaaacacaagcaggaagctagagagtaacatttggggtgtagcagaggatcctgaattggaaactcagcagatctggaagcagaagaatggcactcaagttccatgttagttgctgtgtgactttggacacttcaccaagcctctctcagcctcaggaaattaaaactactgtgacatgtatcttaaagcatttggtaagctaggtcattataaaagtttgcaatattatcacttcatttttactagtaaaccctagttacaaattctgcttaacacatccttaattaaacagtatacatacaaaaggatgagataaaacaaatggttaaaacatgtgaaaaattattttattattatatacatcaaggtccaaatcctggttctgcctgttagcatctgcttacccttgagtacaatgacattgatgttctgagcctctcagttgtcctttgtttacttaatggggataaagatatatataataaggatttaaataagaaaactgtaatatcattcactcattgtgtgtttagtgtttactctacaccaggcaccattacctcatatgccactcaccacaagcctaggaagtgagtgacattatggagagagcccatagcttgtctgacttccatgatcttaaccactctgaaatacaggaagaggagcaaaagaagagtgtggagggaacagagaagagatcaaactgtggagtgctggactgtcccaagcatgtatggaggctgctgtatagatatggggtcccatatgcatcccagaaattgtttctatcccatggtagataatcctgaattgtcttcttcttttccttgttttggccctggttaaaactggctcagctaaatattatagataactcctttcttctctatccccttcccaaacagcagccaaaaaactgagctaaggcagtagagaggacaggaaatcatgtcttcagcagagcagaacaaattccttctctgatgttttttggtgaaataatagagatccatcctagggagccatttgcacagggagcctgcatgtacgggtggacgggtcttgaagaatgctcttatattgctaatgtgcacaatgaggtagagaaatgtgataaaaagaaagagacagagagagagagacagagacagagacagagaggctgtgatagaacctcaaaaccaagcccctctctgtgcaacacaggagactctgataacctcagaaggaagctcacactccaggcactgttctgataagggttacagactatcaagtgctatctctcttctctgagtatcctcctcctcttccttatcctttatctgtcacctatggatttaaagctccagacattggacctgaattagaggtaggtttccaagcagacttttttgcagtccacaccaataatgtagattttataaacacattcaactggacatttttccttctctcctaacttttcattcaattatctgggcatcagagagatcaatatgagttaacagtaaggtgaccactaaagtctagaaccaagaagagcacagctttactcttcattgctcagaccatacctaggagtgtgttgacagatgagtgttacattaagcatattattaacagagcagagtaggtccagatatgagaagctagtctgacatggaagattgtaatggtatcatgaggaactacaagactctaagggagtagaagttagctgccttcaattaaatgaagggctatagtactagcaccacttctaatattaatgtttaacatgtgtattgctatagctgcaccccaggctccacgatgcatgcattatgtatgttataattacaagaactagtatcttttgagtgcttacactgggccagacatctgctaaagggttttgaagttataatttcatgacattctctatgatgctgcaaaacaaacactatttataactctctttaacagatgggaaaactgatcctgagagagattaaggctcttgactaacacagggtttctcaactttggcactattgacatttgaagctggctaattctttgctgtggaaactgtctgatgcattgtaaggtgtttagcagtattcctggcctctatccattagactctagcagccctctccccaagctgtgacaatgaagagtgtctctagatactgccagatgtccattcaggttgtgaaccaatggactaaggtaacaactattattttatgaatctacatctagagattcctaactaaggaaagaagaccatgaagaggtgttaactgggtgcaagccggcagtgacatcactttgcaaaaatgaaaacaaaaaacccagaagagattaaagcatttgataaacgtgaactaaaaggcaggtcagaccactgacaatgcttcaagtccattatcctgtgaatttaaaacttgaggttatttttattctgttttgcagtaactgtggtttagtagttgtagaggaagatgaaaatcttaatttgaaatgtcttctccttagcagaagcctgaagaaattcaccttgcctcaacatgtatgaggttaggaaggtgccactcccaactccatttattcactcctccagcacatacacacagacatacagacatacaccctcttgtccatgcctctgggctcaaaaacaattgatctgattcgttatctagctctccgcagaagaaagctgagatacaatagcaagtcatcagctgtgcagcaaattggcaagtttccactggtttgtaataagttaatgatgcccaagaaaggaagacatagacaggagggaagcccacagcctcccacctgtctcttttcatggccagaacatctatcccctaagctgtatttgaacacagaggagggaagcagaaaggagacatgcacatctctagcaattagagactggaaggaaaaaagacacatggatccaagttagcaggaagcctggtggaagccaatcatccaggtggcatttcagagtcagtcctcaaaagagcctcatgcaaggaattataccaagatgaagttaaattaaagctggactgagttgggctggacatcaaaatgaattcttcaattaacttatatgactcaggcactgaaataaaaatgaaaagggggagaatatggacttccatatccagaaagccaagtcagatctatctgtctgggtgactttagccttcatctgcaaaacagggactgaagcaacacttggatgttgagtatggtatatcaaagaagaatgaaaggttttcttaggtggcatacataaagatgcagaagtacaaactcattttcagttcagaaactgatgagttatttagtatgactagagttcagttttcctatagggttggtgctatagatgagaaggagcgaatgaccccatcgtgatgaggcttaaatgccaagctacacatttgaagtttagtctgtataacatatataagaagactttcatcagaagagtgacactgtcagagatatacttaagaaagatcagtgtaactataactatggaacaaggatcttagggaaaagaatgcatcatgataataatgatgaaaagagctgcaatttattaagccacatggcatgtattggcatttagcacagtgccagtaactgtgctaggcattttacctgaatttcccaatttaatacaacagtgtaaggtaaatacttatacaaaataaaaaaatagaaaaaattaagcctataattaaagttgtgctcaaagtctcaatagtaattatacgtgtagtcagggtactaacccagttccactgctagtgactatgcatttattcaaataaactgtgcaagtccagatacaaagatacagattttgactatagcagtatcaaaggaaatagaaaacaggacatgcatttagaaaagatatgtttaggggttagaatgggcaagaatgaaaggacttagatatgaattggaggagacaggaagaagtcaagactgcattctaattttcccatttggaatgctatataagtatgatttgagagttaactatatcccgatatatccagaagttggttggatgttcccctttgcaattacagacggatgacttgtcattgatatgttccttactatgatcaacttgtctacagaactaaatcaaaactttcaccacagaaaattttaaaatgtcatggcatgaataaatttccacatttccctatcagtatcagtgagtgcatggcagaagggcattgggtgaggccacgtcctagactctgggattttgtcaagactagaagattcaggcagatagccaggaagaacactggtgaaatgtgcaggggggcttgtggaagactgaacttgaaactttggtaaacaaaatttatgcaaatatttacactgtcctattaaatttgcttatcatgaatctctctgtggctttgacctaccaggtaagtcaaatccttgtggtctcactgcttttctgggacaacagacattgcactcactctgatcttcactgcttgcccaccttcagcaaagtctccatccctttctgcatccttgtcctcttggatgtacctggccctccctacctcatcctctctccagtcacagtcctcattcacttccaagctaattgtctccactggtgtatgcaaacgaaccatttatgggaaatgccgtggaatgttaatttcatttgaaattgggtaattgcaaaaagtgcttccacttttttattatatagaatgaataagtattgtattaatagtgccatttccaattatgaccactatcgcaggcctgtcgtctgctaactgtgggttatttttcatggagcatttttctgaacagtttttttaaaatccccccttctttgcaccattgtaattaagataatgcagaataattataaaaacattggaagctcaaatgccagcatagactatccaactagtgctgcatgcttattctaatttctcaagcgaaaaagaaaaagtgttggagtctactgaggaaggcggatgaaggttgatgaagtcagcaagaaattggccagaacagctcagaaaacctggccagagcccatgtgtggggagctgagcttgattagatatttctagaaagcaaccaggaagtgtgctaaagatttttgggtattgaaaaaatatttattgagcatcaattcattattgagttgtgtgccaccatgcacagctaaattttgtgcatctactgtatatcaggtgcttgatatagatgatctgatttccccatcaagacaacttcatgagatttgttttttattaccatttgacagataaagaaactaaaagtctaagacgttaaggaagttggacaacttgaaaaaccagaatttgcaagctgagatttaatcctcgattctactcttagctagttatggcaattagctagttattgctattaagaaccactccaaacaagattgtattcatcaatgtgtttgtgggtaaagtggaggtcagattagtctggctaggctcagttttgctccaagctgcagattgagttcaggtttacttcatgtctcacatcttctttaagccaatggactatgtgggacatattcccacaaagatatgaaagtcacaagaaggatactccactatgaaaatgcatttaaggccttcgtttgtgtcctacctacttacatcttaatggtcaaagtaagccagatggccaagctcaacatcaataggatgggaaagtgtaccctgcccacagtggccaatggggagtgaatatttgccgaatggtaatccaagctattaaataacatacctataaaatgtttcaagtttctacaacaccatgaaaatcacacaggatctaagttcctagggggcaggggtccagtcaaagggaggcatctgtggtgacacagaagtggtatagtattatgtgacctggagcaaggtagttcctcattgtcacttttcccatccatataaatcacaataacacaggaccaatctccctaaaaaggccactggagggtaatcacaataacacaggacccatctccctaaaaaggccactagagggtgactatgatgcctataacaagttttaagaaatggaatgcttctttgtatgctcatgtcctatcaacttgttctgctttattcttcattaaacatattatatatttatttttattatttttcctcccttgagtttccaaatgtatgctaaatgaatataatgactttctatttcattaacttttatattgcccatacctaaaacactgactagaatgtagtaggcactcagtaagatttcttaataagtgaaatgcaaggtgtgcaaaccccagcttataaatatcctgtatatgtaacacaaagaatgatacaaagaactgaacttgcactaactaggtactgtcttgactctgaagaaaggacaaggttttgtgagagacacagtgggatgatgaagatcataatgggaagagatggtgatttcatgttggtactaatgataatggaaattataaagtacacacacacacacacgcacacatacacacacacaaatggtccctcaacttgaaatcaaaagtagtgatgacattttctgagctgtgaaattttggcagatcttttaaccactgcaattctcaagggatcttatctatgtaattggtttaataatatagactgccagaatatctcaagtctctgagataacatgttaaagcatctgacacaaaatatatgtagctaccaggatgatgatgatggtggtggtggggacagtggtagtggtaatgatgattagcattctcttaccatgttgtttttcttgggaaaggaacacaaaaataactcttgtgaaagtaaacagaattaaaaccacacaacagatacaacaaagggctgggggttaaaagtgagagaaagcgcttccattgaggagaactggagcagctttatgaaagaaaaggcgttttttttcttttttcttttttgcaagacagggtctcactctgtcacccaggctagagtgcagtggtgcaatctcggctcactgcaacctatgcttcctgggttcaagcaattctcctgcctcagcctccctagtaactgggattacagttgtgtgccaccatgcacagctaatttctgttttttaaatagagacggggttttgccatgttggccaggctggtcttgaattcctgacttcaagtgatctgcccaccttggcctctcaaaatactgggattacaggcatgaacccctgtgcaggctgaagaggaggcttctctaaagactcttaaagactatgtaagattcatatatggggagatggaagagcaaaattctggcaaggggaaacaaagcaagaaaatctacagagagagaaaagggcacaggtaacagttacaactgtccaaacaattttcacacatttttctttttctttttttttagaatctttagatttatcttagcaattccagagttactatattagttgatttctataatagccatgtatgacatataggacagtttatatcaccactttatagataaagaaacagagactcaaagagagtgcataatttaactttgtagctgggtgaaaaatggaaatttcagctcagaccttgaagtgacacatatcagaaatcaaaatgagttggaggtagatcacccaatagatcatgagaaaagcagatagataagaaccagttagtaaactattaaacttttctatcctatcaggggaagaacaggtaacttttgaagagatgatttatagaggattttttgggaaacagcattattgtgagcctcacctcctccttcctggaggtgagtgcctgctctcttggcaagtgtagagagaagggttctctcaggactactcatggagcttcacttgtggtccctggccagtgatctggtgtccaggtttacaccagggaaatgtatggaatgagatgggctggccagctgctctggtgagagcaaagcagaagtatctgtgtaggcattcgcttatatgcccagagcattctccaaggcccaggtaggatgacaaaccagagaaaacaagcatgtggttaaaatacagaagagctactaaaaacaaggactctaagccagactgtatgagctccaatcctggctcctccacataccagctgtgagatcttgggcaagttctttaagctttcctagcctcggtttctgtatctgtaaaatctgtaaaattcagataataattgtactgttgtacaaagggtgttgtgaggattaaatgagtaaatataggtaaatcattcattacattgtaaggcctatgcatatgttggttagttatcaaaatcatcctaaattccgtggaataaggatgcctggaggggtgaacagatctcattagagagaagccagagaaattattggattcatagaatgagtgaatgaacacatgggaacatgcatgcatccaaacacattaaagaaacctcagaagagagatgggtaggaacagggactggtttctaaggagaccaggaaaatgctcccagacaaagatctttaatgtctaccgggatcactgaagttgaagtcaggttatgaaaatgccagtcaacctttcctgctcctcatacctttctctgccaggctccatctacacggaagccccagaggggttacaaacagtagctaaaaagtaggggaggaggtaagtgacaaagagaaagcaagcaagtttcacctgccttcctcagctcccaagacagctacaactccagttaggggagcagaagggaggcccacctttgagtggagactgaaaggttggcaaatatatggcattgaacatctctgaattgagactgtattttgtacattcagtaaatgctggactttgtattacctaatgctgatcagaaaagtcacaggactgccaagttttcatccaggggcagaggaaaaactaatgccataatactactcaacaagtataaagggtgataggaaataagagtaaagatgctttgtgactgcatcacatgggccattcctggacagcatactgggttacaactttctcatactatttttgtaatacttactattttattacatttatacaactttttttcactctagccagggcttttaaataaatcatcacaaccaatccagataaaaattacttagcatggaagtggcagaatttgacttgagtctacatctcccaactcaggaaccattctccctaccatgagacaatcgatatatacaatttatgagtctaaataatgcatttttccctttagttcacacttggattgaccattaataagtcttttttcccccaacgggttaagtacttttgctatatattcccattttattgtagacttccactcttgtaacacttttcataggtgcaatgatgtgtgattgctaccaattgaaaatgacttccacacaggcaaaggccatatttgtataacttatgactctccagcgaccagcatagtgcctggcatatagcaggaactcactatatgtctgataaatgaatgaataaatggattaatcatcattttcaccatcagtttcaaagcactgatctttttgagttcagtgattttttgattgataaacaattggtttcatgcataaagatctgtcttgaaatatattttcaattaaaacattacatccactgggttttaatatcagttttagaagcatccacttttagaggtatgtgaaaccttcaaaatcatgattttcatatggggaaactgagtcccagaaattgagaacaacattgagacaaggtcaggatgagaatgcaggcagaaatctgcccctaagttcagcactctttctgtgacttccaactggctgaagaaccctttggccctgtatagctgattgtttttatggattcatactccagggtatcacctggtgagactgtcattgggtgtaaatgaaaagtgaacagaagcctggaggaagcttccactctggcataaataaaggagagcagaatcctagcctaatgttgtatgaagtttggggaaagatcaatagctattaaatcaaaacagcctcctggtctccttaaacccctgccccccaatcccctccaggtagccagcaggctctgaagtgtgttattcatgggtagatttgaggttgtgaatgaagcatccttatgaaacatgggcctgagctgaagcagcgaaggttcctcagggcataaagatagggatctctgacttctccatgggatgtcaggctttggtgaaattttcctggcacatgcctgacccctgctgctgtgaactttgctgggagcctacccatccctcactgggcatctgattctcagcaggtgttcaggaggacaaatggtgatagccaagttgaatgaatgccctctccatgtgggcactgtactaagtgcatggatggatcatctttcacttctcccaataacctgatgagataaataacttcttattatggccattttacagttgaaaaacctgcagctctagaaggctaccacacttcccccaagaagatatggctggtgtagggtagatgaagtatttgaacatacagtctgacttcagagcccacactgacaaccactgagctttgtaactcctacagctcacatggtggcaatatttgtttggggaggtcatggcctctcaacacacctccctgatgctgccctgcctattccatccctctcccgccatttgcatttacactgacgtagagtgtatgagtcttttgacgaacacttacaacatgccttgtatgattttagttcattacagtcagtacttttcttcagtctctgcacagtaggtattgttacatctgccttacagaagagcaaatggaggctcaagaaggtgaaatatcttcctgaaggtcatctgggcagcaaggggcaaggcttagattctgagttcaagggctgggctcctttcaaagtgcttgagtggagccctgcctgactgacccagattgaagtgattcccatacctctaaactgcggctcctcttttcctgatactgtcttcatggaatgcagaactgcgcagcacggaagtccaacagttaactcatgataatggatagttacttgtgtcatgagactttggggtcctgagagtgagggccacctgtgttcactctgcattccacacaaacccttagcccagcacccagcacactatagatatttaaaattccagtggcaaaatgtcatcctctttctccataatttcagctgtgagttacggagcaagtcacttcatgcttcttaaactctactgtccatgtctatcaaaatgaaataataccacctccctataaaattggttgtatggtgaaatgaggaactaaatgtaaaacatctattattaaatagaatgccttatgcaaagtaagtgtctagtaaaataaaacaaatacattaaaaagccgttatcataggaacatctgcacctgaagcaacccattgattatctgaggtttccaaacctgtgaaacataatcatggagtaaaaagtatctctggaaagaaatagaaaacaaataatcctgcttattagtaattatataagacaggtcttaacttagttaactggttttatggtacacagacattgaggcttatcaataaaattaataataatgatgctgatgataataccaagcatctgcataacattgtataattctagaatgttctcatttatagtaacagtggaagggaaaaagagacacaaaaaacaaatatgcaggtatggagtctgaagggtcaggtcacaaaggagagcccagcaaatcctccggtatggctcccctgtctctctcctcttcagtctcatcctttctaactcatcctttccgttgtagtcaatttgatctgccaaaaattcaaatagaatcttataatttatctgtctaaagactcttcatgactttccactgcttttagaacaaagtcaaatgcttgcacatggcttgcaaggaaggccctttacagcctggtctataacagcctcttcatcacttgctgctatctattcctttgtgaagcaaaacaagccaaacctaacgtctcacagctccttcacatataattttctctttcacttcaaatacttcctattcctcatctcccctagctaagagctacacatccttcagatctctgattagctctctgctactcagataaatctttcctgaccctctgcagtaagtggatccctttgttaaatggcagcatctaattattccctcataacatactcttattattcagtatcttcttccccatagactgcaaactcccctaggatcaaataagatattccatatttaagaacctggcatgacaccaggaatgcaacatgatgtttgacttctttcctctcttagactcagtttcctcaaagggataattatgttgacaacatccattcttcctgccatactgggctggtatgaaaataaaaggacatataaaagagtaatgttaaaattcccaattgctattcatttagcagtgatatttatcttattttgtaatttagaaagatgatctacaaaagcaaaaccaaagtaaaccaaaagataattcgaaattttgataggtaagattaggaaaaataccatcaatgggatctgaaaaaaacctcaaaatacttcgagcgaaacacacgatctatattgatttgtctataatgctctatctctgtcatctgtcatcagtttatctatctatctacctatcatccaatgttgatcacaccaaaaccttttttttcaaaacatttccttaattgctaaatttttgtgacttcaaagaaaagtgaaatccatataattctgagtcatctacagttaaatcattaaaacattactttttagtggtcaggagattttgagatgatttgaatacatttcctaaaaccattatcttcttctctcttcattttaaccacccttcctaaacacaatgccacactaaggaaatgagcaaaatcagaatacaacaaacgctcaaaatactgtgggtgcatgaactcataaaacatgaaataactttctgggagttggaaatattggctgaaaacatcattttctcttttgaacctgaatgtgatggacaaaaccaactgaatcagggaaaaaaaatatctatttagtacattatcaagcatctatgataaaccaggctctgaacaaggaagacattgactctaatctcaagaacttatgttacagaagtagagagagacatcaagtaatttcatgaatgccatgcactgcactggactctctgtgaacatgttacaggtaaatctgatgttatctgggatgtcagcaaacgttttcctgagtaaagaatatccaaggtaacatatggcttgacttttagcctaagagcaatgttttatagccatggaggtgataagaactgatctaaattttagagaggttatcaaggtggctttgaagagaaagaaacccagggcagtgggcagtatgatggggtagagaccatttacagaggccactaaccaagtcagcttctttgagactcagtttttttcacctctaaaatggaggttacaatccttctttctccattgcagagttgcctggaggagataagaggatagtgggaggaactaagaagctggtgggaggagctaaaacaataggagggagagctctaaggatgatggatgagctaagagaatgatgagaggaactacgaagatatgggaagaaccaagaaaattatgagtgtgtgaatgcttcacaacctgaaaatgctgtgcatgttaaattaatgggaataaaatgtactttatcagtgtcttcacttccacaaggacatggatcctgtgatgacctacggtcacacacctttgatgaagtatgagagtttttaacttacatttggaggtgagggttctgtaccctgagatcctaatgaaagccagagcgttgatgaagtatgggagtttttaacttatatttggaggtgagagttctgtacccttgagatcctaatgaaaaccagagcctttatttttttagaaaactgcttagtgtagaacaatgcctataatcctcaccgatttccagacacatatgccctgtaatcaatccagggacctcatgttagaaatttcaggtttagtataaagccttcagtcattacagcagttcttttctaacttgtcagattataactcatagtaaaaaatacgcatttaatatttctagccaactgaacaaaagttgcatgaagcagtaatatttcctattctctcctgctatattgttctctatttaatgttattgcagtttgtttttttcatgattttaaatgctggctaagacttataaattgaacctaacttgtagtgcgaaaaacaatgtttaaagaatgacaagcctatttttcagttttgcctctatctgttaattgcaggggcaatcttggacaatacacatctcctctgagcctcaatatcctcagctgtaacatggggataatagcgcttacctgaaaaactgagacaattaaggtaatactataagaaatcactacgcagaaatcatggcacagactaggtgttcaataaactgtagtgattataaatagaggttgctaatgggggaattagagcatagctaaatctctcttgcctgagggaaaataaaaaggaagaagaaaaagaaaaaaaaaaaatctcattcattttccacccagggggtctttctgtcttccaaatgtagctatttgctgtggggagaggaactcagtccaaatgcctctgtttgctgtgacaggatttataaataagtaaaacgctttatcaaacatttatagttgtgtgtgaatccgaaaagaaaaaagaaaggaagaggcacgtgggcttggggtttatttatagtgactctctgcttttccctttcctgccacaattgcacagcttagctttcatttgcttatgattgttcttggataaacttcacttccaaacagagggtattaattattaaaacacagaccagataaaacagcccattctgttcccccaaacaatgacaggatgatgcggcagaaggaagccactagaaaaaagggcagagaattgccaacacacgctttcaaacagagtcaatctttggcaaaactcatgttaacgaacattctgtgggcgcctactatgtgcagcttggaggctacgtcagacatggtggggtggggcagggggctggtgtggggagggaaggtttccatgatgaattagagacagcttttaatttatatcccagtgaagggagggagttcccaacaaaagcaaggaggagatatgtaaacaccaaactctaagagaaagtgcctctgaacaaagtgctttgggaacggcataacagagtacttcctcttaggaggcatcctggtcttggaaggagagcagctctgggatctggctatcttgggtttgaatccctgttccagcacatcctacctctgtgatcatgagcatggtcatctcttcatgacacaggtgtggttatacctcttggggaaggtcattgtgaggactaaatatgaaaattcatgtgaactgctagacacactgcatataatcattaaatagcaagtatttaatagtaataagattcagtttggcacatagtaggcactaaataaatctcatacttcctttcctttgcttgagagtcttaattcaatttcaattgcatccaccttccagccactccaaatacaatgtgcttgtatatcattgacatcctctgtttcccattgtgtgtctcatccttatatgacctcagttgcaatcttcttcagaacttatctattaattaatgtattcatccattaatattgattgagcacctgctaggtgacaacactgatgaaggcactagggattcaatgaagaaggaagacaaaatttctacctgcatgaagcatgctttctaatggggcagagagcaataactgcatcaataagtaaaatataagctttgtcagatgatgctaaacactaaagagaaagatcaggcaggaaaaagaagcatgaattgctggagtgagtgctatttaaaatgagaaggcctggggagaccttatggggaaagtaacatgtatgcagagactgaagaggtcacaagcagccaggtaggtatttaagagaagagtgttccaacagagaagacagcagatgaaacaccttgaggcagaagcaggcttggccgtatcccatttctcattttagtcttcagaaaagaggcagggagcagagtgatttgattttgcaaaacaactctgcttttcccacatactaatataagcaagccataccttgccaggtatcgtatccattgtccacattaggttccacaaatacatgtaccaagagacagatgcctagatgtgttctgccccttctttatgtgacagggcagcatggttctaggctgggctcaaagttgctgggaaccgcatcattaccaccaaccatgccatcctgagatcctgagctctccaaggatgagagctctcagcgacatcccatagaatttggactaacttctcaggatgctagcactttgcaggaggaatttaaataaaactagaaacaaacaaaggcaaaagaaaaaaagaaaagaaaagaaaaaatattacgaggaagcacagaatagaaatattctcctttgcccaactaactgaaacatttgcaggtatgcaatgcctcacagagtacaggtacagggttagtgtcatgtccaaagagtaaaggctccagagaaagccctgcctgcatgggttcctggcctagctgtgtgactgcagaagggttgtttaacctctctgtggatgaatctataaaatgaaactaataacagtacttttctcaaagcactggtgttaatgtaaaatgagttatttgagtaaatgtctaacctagtacctggtatggagtaatctatttgatatggtttggctgtgtccccacccaaatctcatattgaatcataatccccatgtgtcaatggagggacctggtgggaagtgactggatcatgggatcggtttcccccatgctgttctcgtgatagtgagtgagatctcatgagatctgatggttttacaaggggctcttccccctttgctccttcttctctctcctactgccttgtgaagaaggtgcttgctccttcttcaccttcggccataattgtaagtttaagtttcctgaggcctccccagccatgtggaactgtgactcaattaaacctctttcctttataaattaccgagccttgggcactttttatagcagtgtgaaaatgaactaatacactatctaaacattagtgtttaaaagaatgactatatacattttagtaaattcatataaggggacactatatcgtaattaaaaaaaattatcaatacttgcaacaacatggatgaatctcaaacatgatgttttgagtgaaaagaaggcagacacaaaataacgcatctgtaggatcgcatatctatgaagcacaggaaatatcaatttatgatctaagaagccagagtactgtttactttttatgggtggacatggtctaggaaggtacaaaaaaatgaaacataaggggtgctagaattattctatcataaggctgcccagcagaactttctgttacaatgacattgttcatattctatgttgtgtgatacagtaggtactgtagaataggcatatgctgccaccgggtccttagaatgtggcttgtttgaccaaagaactggacttttaagtttaattaattttcattaattttaatttcaaaggccactgtatcgggaggcacagatctatatgttggtctgggtggtggttacttgagtataggcatacataaagaaaaccaagaatacatttaagtctagtgcaatttatatgcactgcatatactttattgagtgttaccttttaaaaattagctatgactattaatctacatgcatcacctcatacattcctcacacacttgaggtaatatagagaggaaagtccccattgtccccatttgtgaactggttcagctgtggctcagagaggtggatgtgatctgggaatggtcacgtggcttgtgaatcccagagtgggtaacatttctatccaagttttctctcacgaatgggaaaaaggcagtgtaaaataacctgctgagatgatttcattcaacaattcattcatcaagggcatactgtttgagtgccagatgctgttttagatgcttaaaagaaaacactggacaaaagggaaagttctggtttccatggagctttcattaggaatctttgctcatcccacactttggccaccccttgggtcccttacctgaagtaacttgaccatgggccaaattgtgtgaaatcagactcaactaagcattcgcagttacctatgctctagatttgactcctgcttcctactggaactacctaggcttcttgttcttctagacttagattttctcatttataaaataaggaaagggataaaagaagacatacaggaaaaatactaactagcataaaggcaaacagcatgtatggcaataaagattcttattacttaattgtaaaacaccaattacttacaaaaaaataaataaaaccacagcaatccaaaacttcattcacttagcaatctggccccaaaacaagaaagcaaaacctgttagaaacaaatgaaattcaccaatcttgagtttgaatgaaagatttttgcacatctgtcttaaaagcaaccgtaactacaaaaaaatcaagcaggcaaaaaattagatatagaaatttggtcaataaaagtaacaggtagtatctaatggttacacatgaaatgttttgtccattaattagaaaatgtacagtgtttctcaaacacacagaaactatttataaaaagtagccatgctccagggtacaaagtaaacctaacaaatagccaagaatttaatagtacccagaacatattatttaataaaatacagtaaaattagtgttaataacaaaaagttttctaaacatatgcctggaaatgtaaataaaaatgtccaaataataaacaaaataataaaaaaatagaattaaacaacatgcacgctacatagcaaaacttgaggtctagagataaagaaacacttcagagaaagttataccatttgatgcaaatattgttaaaaagaaagattgaaaaataatcatctaggcatttaagaagttaaaaaagaatggcaataataataaagaatgtagaataaagaaaatatgataaaaattaatgatatagaagagaaataatatagaatatcaacaaatcatgagcaaagtttttttaaaccttttatcactacgtcttgctctctctcctttactcttactaaaaaacagaaaccaaaaccaagaacaaaaaaaacactaataaaatagatataatataacaccaacaagattgacagacaaggcataaaaacaaaatctctggaattaaaatgaggacagaattatagatgtggtagagacttgggatatgtatagctagctagctaactagatagatagatagatagatagatagatagatagatagatagatagattagatagacacacaaccatgaatacacatacttatttatcacaggtatacaaacacacatgcatatataatactatctgctaaatatttaacaaataatattaaacaacacaagacaatatgtctataaatgagacaacttagaaaaaataagtgagtctcaggaaaataacaaatactaaaacagagttaagaagaaacagacaactaaaatagccatataaatatttgaaccaatagtcagaaattaccatctaacaaatagacaaacatcaaacaaatagacttaagcataaattctagcaaactttatgagatatacccacttcacataataattacatatacaaatatttatacacaatagcatgacagcacaagaaggaaggctgtgtaaacctcatgttttatgaagctaggataatgttgatattggaacttaacaaagatgttaaaaaacgtaaggatagtttactaatagaaacgacagtaatacactacacaatcaggttaaaagagaagacatcacctcacttgatgctgaaagagtatttaataaattgtaatatccaatcacggcttgaaaaatgattagtatattaggaatagaaggaaaatttgctgtcaaaagtttactaacatttactatttggttatctaacaaaaacctaacactctatcattatgatatattatgacatatagtgatagagctttagttttattttctttaaagtaaagtacaagaaaatggcatgctctgccatcatttttcttcaacactgaatgggaggcccagtctggaagagcattagaacaagataattcaaatacaagatacaaagattcgcaagactattaatggcaaattatgtcattttttccacatgaaaatttaaaaaaaatctagaggctaaaagtaataaaataatcacatcttctggcttcaatcaaagaaaaactgatgttcttatacacaagaaaggaacaattaataaatgtaatacaagtgaaaagatacaatttgcaacagttgcagaaatagtgatgctggtagaaattagatacaactaaaagtctgtgatatatgtatagataaaatgtttagatgtttaactctattcatagccatacaagaaggctcaaataaagaaatatattatttcatggatgagaagtctaagttttgtgaattttgcaagtgagtctgtaaattgaatgtaatcccaatcccagtgacagcaagccttttcataaataagactttatcttaaaattcacacagaagagtaatgagagaaaaatagctaagacatttacagaagaaaatgaatgagggagtcctgccctttctgataccaagatattacaaaaccataataactaaaagtagcatggtactagaacaggagagctcagaaactgacctccagatacacgaggacttgtcctatgacagtggtgtcataaatccatggagtaagaatggactccagatagtgaactaggacaattagctatccatgtgaaaaactaaagcaaacaaagtccatggttaaagactgaaatgtttacaagcaaaatcttaaaaatttagaagaaattataggtgcataactaagacactaggatagtaaaaaattctaaattcctcagttattcacaaaaagtataaactacaaatgaaaaaaacattgtagaattaaaatgaaaatattcaaaattaggaaatgattttcttaacaaaactaaaacataagtcatagattggaagaagatattttcacatgacaaaggcctacttatgtttttaaatatgattattatcaatatttataaggaacatttactaatcaggtaaaaaaaaaaccatcataaaaatatgcaaaagatataatcaggattgaaaaagaaagaaaatttaatataaggaaaaatgtttaacctcattattatctttgacatgcaaattaaataatcattgaagttataatttcatatcttacagaatggcaaaatataataagggttgtcgagaatttgggaaaatgagagattttattcattgctggtggagtgtggtaagataaaaaatttaaaagcacaggacacaggacaatcttagataagattatgataccatatataaagtaaaagtataactatccaaataggttagaaatatcaacctttgtgtagtaagaaacagaatcagtgaagttgattagctatgtgtaatttaacattttaaatgtaaaaaaatccgatgtataccacaaaatatttgtattctcatttgggtggttagaatatatgtaattatatttactttattgcatgataaaagtaatttgtaactaaaaataaagtacattttaggagtattttagaaaagatttaattgaagaaaaaaaaagatagatatgaggatgtaaagatgaagccaagggaaagatcagcgctaaaatttaacttacagtgccaggtacagtggcttacacctctaaaccccacaacttgggaggctgaggtgggaggcttgctcaaggccaggagttcaagaccagcctaagtagcatagcaagacttcatctccaaaaaattgttttaattagctaggcatgatggtgtactcctgtagtcccagctacttgagagactgaggtaggagattgcttgagcctatgagttgcagtgagctatgatcacaccactgcactctagcctgggtgacagaataagaccttgtctctaaaaaataaagaattaatacatacaatgtctggtatatttcctagagtttctgtttcaaattagactctgagcattctagcagacagtacaaacatggaaaacttgttatagtattcagatgtctaaaaagtttaaaataaccatctggccaaagaacagtaatcctgattctggtttttgaggacaatgttcctatttcataacctgtgtgagttattaagtaacagcctcacccagaccctctatgaaattagagtgaactacaatgaggtctaatgataaaaacagtacctgtataggccaaggagtgtctaaacagtttatgctctgtaactaacttaatacttacagctagccttgttttattattatcaccattttatgcataaggaagctgagggacaaatcagttaaataacttgactcagtcctacagctgtgaagtggagaaacctggaacagaatgcattctctccaccgcccggtgttaatgtcatcaaggcaaagtcagcttcacagaaatagtttcatcatctccaagtaagatggtccaggtgtgtctgggaccttagaattgtgtgaccaaagctatagattccctccctcagaaactaaaggtacccaatgttttgcaaatattttcagtgtaaaactcaaacatgggccccacattttaaaaatcctactctagaaaggagtgagcaaattgcatcttctcagtcattgatctatgtatctacctgttcaccatggggcatccttaatttgggaggattgctaatataattaacatagtaggagtgcacaagaactactagttgtgattagagtcatcatttttgttattgttatatgcagcaacctgcgacctgttctctcagcttccatgtgtggcctctaatcctccatgcttcctttagtggtaggtggggccccttcaggaataaatctgaacttgtccatcctgtgcctcatttgttccacactctacaagggcttcacacttagaggagaatcccagctctttaccatcaactccaaggccccgtgtgatcgggccctgtcttaggtctccaatctcaccatctataattctcaccttttcttacccactccatcctattgtcccttgttgttggaatctatctcaaagccttgccttatttcaaatactctcttgttctctgataatctctctgacttagcagtgcttcatccctttcattctttattctctctactccatcttgacccttatctccatccttcatgaatgtttttatgaatgcattcatgtaacaaatgtccatgctctccactagaatgaaagctccacaaggacaagtactggtctattttgagcactgctgtgtccctgctacctgaaaggcacccagcagagaacagacactcaatgagtgtcagtgaacagaaggaaaggagatgggtagggaagtgagttggtttttgtgatgataacttttggatactgttttggacagatctgtgtgcccagttttgaagtagattggtttcaccctcaagcacttaaggaccagagatatatgtccaacaggagaggccagcatagacaaaaatcagcagcaaattccccaacatccctcactaactgctccagggcaggcaatgaaaggacaatggataagcgctcagagggacaaaatcagagggggcaaagttctaggatctctgctggcaggaaaagtgtggaattctggcctgcctatcctggcatagaatcctcaccactcagatccaattagcaagggcacagagaagacgcaggcagggaaatcaaagtgccaagggctggcaaaacatcatctgcaggggagaaggctgggcccagctgggctgcatagagcggcaccagccctaattaagttattagacacacatggctgcagccagggtgttcctgggcccaccaccacagacagtgatggctctgtgggaggctgctgactcaggattccaactgagctccctccagccctctcatagcctgtttttccttctcctttcttcctttattcttttgtaaacatagtagatgaagcggatattccctgagagtagtaacagagataacgtacgtgcacacaatccttaacagtctatatgacacaccattagctcatttcttttatttatgtattcagccaatatgtattgaaggcttactatgtgccaggaaatatcccatgtgctgattacagagtatgtgtgaacagacttagaattccaaccaccagagctttctttctactttgggaaggacaagactatatatgtacacagcatatgtatgtatgcatacatgtatataaatatatataatgatatgctgatatatacatattttcacatatatatgcttatgtggggatatatatgtgtgtgtgtgtatgtatatatatccacatatcttctatatatagtcatcttgagataagtaacccagcttgttgccgtttccatctcccacatggtgaaccagtctccaagaggtaaaatggattacttaggatgacaccatcctaataggagaccccatcatttgtaacactagggaagggattagcaatattcttctggctcctaaaaggaagtctctcttcttcctcttcttggttgcttctccttcttgcacctcttccttgcccccatctcttctcttacctttgataaataaaagtgtaatgtaacgacatgagggcttccctcctatgcttgtttctctcctatgcttgctgtactccaggactgctgggcctaaaggcacaggcagggcctttctgcctgattctgaaagaccccactgcagatctgtcattcagaccccactgcagatctgtcatttcaggctgctgaaagttggtgtttagggacttactttacccccaatcccctggttttgccatttccttacctcagacattaccctccctattcaaggatgtaggatgtaggtgatggatgatgcttctgagatcattggttctcatttgatagatgggaaaactgaggtccatctaagggcatccaattcaaatggcagatctgcagcaaagctttgaataaaatgcagggaggcccatttccagatcagtgctgtatcatctcttggagcatgctagctctgcatctctcttttgattcacagagtagtcttccattcttgatctctctgccttttttctgatctaagtttgtgccaccatgttaaatgatctttctgggaggaagactatctgggcatgacacttctcagttaaaagttttcagtggctccctggggcctcccagataaagtcccaggaccctggtgatctgacccatctcttcctctacagtctgctctttctgttcatgttcctttgttgccagccacttgaaacttctcacagttcctacaatgttctctccctgttgccttgggacctttacacatcccctttcccttgcccctgggttcactgatgagcttatcttcaaattcagctcaaatgtctcctcttgagggaagttctcatccacatcgtcagcacatttgaatgccatttcctctgtgatcctggaatatttgttcatatccatatttcagcacactcacagcaatcatttattgactgcttactatgcaccgagcaccattctaaacaactgatctggagtatctttttttttttttttttggacaggaagtagaatttattggtgagtattaagagggggcagcacagtggaagccctcatgagtgcagggcccgccacttgtccagagggccacgactggggatgtacttgaccccacagccatcagggatgagctgcttctcagccaccatgtcttcaaattcatcaacattgaacttggtgaagccccacttctttgagatgcggatcttctggtggccaggaaacttgaacttggccctgcgcagggcctcaattacatgctccttgttctgcagcttggtgtggatggacatgataacttggccaatgtgaaccctggtcacagtgccctggggctttccaaaggcacctcgcatgcctgtttggagcctgcactggggtagcgcaaggtcagaaacataaacatacatctgaaaggcctgtttccatggtcccttaaagcaacccatacaacaaacaggctgcatacactaccaagaaagctgctgtttgcagccattgcacaatgggcccccatgaggaaaggaacccagttggcttaattggctgcagatgatctggagtatttcaattattcttcacagcaatgtataagctgagaatgctcacataactatttcagagatggggaaactgaagcccagagatgtcaaataacttgccccaggtcaaagagctggtaagtatcagagctaagattgggttctggcaaatgtctcaaatacatttcatactgctgaaattgcctgtttactcaactctcttacacacaaccataaacttgttgaaggtattaatccctctataacctagcacttagcacagtgacttcattctgtacatggagtgtgcactttgtaaatggccaccgagtgaacaatacaagactctcttctattttattttatagcatgctagacaacaggatagcacagtggcaaaaaacacagactctggagtcagacccaggtcccaattgtagctctaccacttcctggtgcttaaagcaggtcctgttttgcctggtctgtttcacagggctaatgatgataccatatggaaaaatcatgtgtattaaataaagaaatccatagcaagtacaaagcatagcacttggatctcaatagacagtagatactcagtgtttgttataatggccgttatcattcactgtgttccttcccttacccctttctttctttcctctctctttcctgctcaccttaagcaagaggcgtcctctcagcaagactcgtttgggattcgcaaaagctgagagggagcatgacttctctggcccactgagcccagtgccctccttccccaccccatgctgccaccttccagctgtgaaatggtgtccctgctcaactgggccccaaagctgtcagggggctgccaatttcacagttcacaaggctgctgttccccccgattaatggggtgccagcagccatgggcagggctctgataccagtcatatgggctctctctcccctgcccacacttcctgaggaaaagagagcaggccagcctcatgcatatttatgtagggagagaaatgattttgtactgcatgccttccaaaaaaaaaaaaataataagatttcacccaagtcccaggcatttccctgagtgaactcagcatgcttcagggaagaaaacgacacagacacagacacacacacacacacacaaacacataccccacagatgcacacatggcataatgaaaaactgaaaacactttatataccactgatctgagcagagtgttctcacaccaaggatgacccaggagacacaggagatattaaaccctagagcatggacagaattattttgaaattaatccagttccaccctatagctctagggaaattagaacagataaggtccaaatgtagccgggcactcaaggcctgccccaccacctcctaatcactgcttttgtctacagcattcctgacctcagactaagctgttctctgttccttgtataagcaatcactttcggtggtatatgccatagtggggcagaagaaaagctttcatcttagggcaatcccagtccttctgttccagttacagaacgtcttaaaagccacttcagcttgcagtgtctcggtgcccccatctctgtgtcctagaataaactgacccaggcttcctcactgtgtttgagccacattggccttctaggccattaagcaagccaagtttttatttcaagagactcttcctcatattgaaacatcacgttgggccccacaaatacagacaattattatttgtcaattaaaaaataaaacagaacttttaaaaagatcactttctctgttcttcagttcatttggttgaacgctacatacccttctaattccagcttaaatcttccttcctcagaaaggccttcttgaacagccaaattgaggtcaagtatcccctttcttctcccagagcatgcagtatgtttccttcctggcagctttgtgttaattaaattagtaattgtgtgataagttggttcaagtctccagtctcaagtctgattttctcattagaggatagcatctctgagggaaagggtcacgccagcactttcactgctctgtcctaatgagtatttggtaaatgaatgaatgaatgaattgctgagtagttgagagaattaaataaagaagcatataaagcacccgatctatctgcagaggacttgctcacaatgcactataataactaacattaattgaccctttttcttgtgataagcactcctttaagcattgtgacatgtattaatcatttagtcttacataaattacatcatttgttcttacaacaactcgggtatccacatccttattgtctccattttagaaacgaggacagtgagaggaaggggagcatttactaatttgcccaaggttatacatagctagtaagtatcagtaaatttcaggagttgacctaggtagcctagtcccagagtccacatttctatccactactctctagaaagatattagttccatcccttcaccttccctctcagatatgttcaggcttagataccttggttgaagactttgtcttccacaaagcctttcctgatttgccagcctcactctattacatctgaaaacctacatccccctttcccacatccatgcatagagagctggggttatgaaatgcagccctgatatcagaatatcctctactgccctccctctggatcttttatgggtggagcaaacctcattttcttgcaatgtgaggacacagtccagaaattgctttctcctctggggtcctacagggagacacccagccctcagaaccaagccaatttaacactcaggagaaccctctcctcctggaatatccatctgacctcctttctgagatagctacaggttaagagccagaagaaggtgtagagacctcacaatccatctgcccacatataaacaggctgaggcccagggttgagaaggacaactcaggcaacagacacgctgaaggcacagcccaggctctctcatttctacctgactgcccaccctctgtagcatactgcctcctctcccctggagcagagccgggggtatagcaagcagacactgccaaggacatagctggagctgtgccgagccaaagcaggcagactgtctgtccatggggcgaggctgcttcctggggtgatgaacagcgccaatcaggcagcacttaacgcaattataatgaagtagatgcatctgttctccgaaggcttcattcaccagggaaatcatgaggaagtgatatctctgtctgccgacctccttgggacactctcagggacagtcctggagccaggaagctgttgacatggactggagactggcctcagccatctcagaatgacagtgactgacaccctttatctcttttgcatcatttctgtaaaaggagctgtcagtagataagagttcgcatgagagaatgtcttcctcttttcctggtttttctaataacctcaccccctacatacactgttggtcatgcctgcaagtcatatggcactgagttccaactcagcttccactgattttaatgtatatccacaccccacagttccactgaagaatgcaggtttagaccagcaaggaagggtccaagctgttcatgatacagatgggaagactgagactcagggaggagatatgactttcccaagattattactatttgtgtcaggtggcctctacaccagattgttcatatattattgcatttcatcctgaaaataacctgagaagagtccaacactattaaaagccagcttcacaggtaaggaatccgagactaaaagaggttagttactctgtccacgattgaggcactgtatgggcacacgattcatacccacatctgcccattccacacccatcttgctactatccatcatcccagaaagccctgacgttatagattggctttggtttatagactagtgtgtctataaacattttgataagctaaaagttgtttaaatcctcttcttttttacatttattcctagtgctatatatgaaaagaatcctgtggtgaattgcttttgtaaaatgaagaatcatttaggaaaataatctgtcacttcctgatttatttctttgctaagctgagcttttcacaaatcagtctcctttgaagcaaggcacaccagccctgctctgggcagatggactccctactattctggacaggatatgatgtttgaggatctgccacattcacagatgcgtgctttagtaaaaaggagctgcagatgcttcataacctagagtgtggcttgctaggtaccccaagactccaccatcctgataaagctgataggaacagagctctatatctgcacagagtcagatagttccagattagcttatggatggtgacgtctcctggtgtggggatctcctcactagggcattcagtattggatatgacaaattctttcatggagtgcttgaaaagaaggcatgagagaagagtcagaggcaggcagagcatgtctcacaaggaatggagatgggctaggcacagaagctgtgaagcagtagaagccatgggcatgcagaggttaggaagcatagagaggttatttccaggtgggagccaaagaggaacagagaaaaagaggccaagattcatgaatttagcagagctacttgaggcagaatcaatgagccaattgctgttatatccaatcaatagtgtatctccatgaagcctgagactgtttctgatcatacctgtccttgtgttcctcaaggaacagaaaggtaaaggaagtacgggaagcagagttattggtgaaaagagagaatttcaaggtcacacagacctagcttcaaatcctgggtctaatacaaaccaggtacatgaccctgagctagttaccagagcctcctctgcttcggtctcctcatctgaaaaagggagtgattagaagtaatgaccatatcaattttttgaaaattttatgcgtaattatttattaagtactggtcacacaacttggcccatatagagtaactaatattactcctatttctactaaaaataaatcctggccgggcgcggtggcccacgcctgtaatcccagcactttgggaggctgaggcgggcagatcacgaggtcaggagatcgagaccaccctggctaacacggtgaaaacccgtctctactaaaaaatacaaaaaattagccgggtgtggtggcgggcgcctgtagtcccagctactcgggaggctgaagcaggagaatggtgcgggcctgggaggcagagcttgctgtgagccgaaatcacgccactgcactccagcctgggcaacagagcgagactctgtctcaaaaaaataaataaataaaataaaataaaataaataaataaaataaatcccattagctgaactaaatagccaatcatttgaaatagaaagaaactgaattaaggcatttaggtaagtcttccattgattcatttactcacttgttttatcaattcactcctcaattatttatttgctttctatacagtgccaggcaatgttctaaacaagaagcagacagcatgggacaaaacagacacaattcttaaagatggacagataatacttataatgggtcaaatggtggcaaaaattataaagaaggccgggcgaagtggctcacgcctgtaatcctagcactttgggaggccaaggagggcagatcatgaagtcaggagtttgagactggcctggccaacatggtgaaaccccatctctactaaaaacacaaaaattagcagggcgtgttggtgcacgcctgtaatcccagctactcaggaggctgaggcaggagaaactcttggacctgcaaggcagaggtcacagtgagctgagattgtgccactgcactccagcctgggagacagagtgagactccatctcagaaaaagaaagaaaaaaatagaaaaattaaggtaatggagaacacagtgtggtgcatgtgtgtatgattatgtacattgttttattttttattttatacaggctggtcagggagggccttagggtgctatatgaagaaaaacctgaaggaactgggggaacaagccatgcaaagccctgaggaaagaactgttcaggaagagagaacagagatgcaaaggccctgagattgatgaagatgatgatgatgatgctaaaaaataatgatgtgctatggtttgaatgattgtctcctctgaaactcatgttgaaagtcaacccccaatgtaatagtattgagagatggggcctttgagaagtgattggatcatgaagattctgacctcattaataggttaatccactcatgcattaaaggactaatagattaatgggttgtcatgagaataggttagttatcacaagagtgaatctgttttaaaaactaggttggctgtctgtcacgagtctccctggtcatgtgatgccctgcgctgcctcaggactctgcagacagtccccatcagcaagaaggccctcaccagatgcagccctcctaccttggacttcccagtctgcagaactggaagaaataaatttattttctccataaactacctagtctcagatattcagttaaacagaaaacagactaagacacaatggaacaataacattgctatcctacatctgtgtagtatgttacagttacaaaaagcattcacctttataattgtttgttcctcccacgttcttgtgaaactggaatctccattttaccaatgtgacaaccaaggcttggagcagggtttctcagccttgatttgatagatattttgaggtgggtaattatttgctggggttggggggcggtcctgtgcattgtagaatgttaagcagcatccctggcctaacccctccctagtcatgacaaaaaaaaatgtcttcagacattgctaaaggtctccagtgaaagatgtgtgtgtgtgtctgtgtgatagagagagagagagagagagagagagacagagagagagagagagaggaaatcacccccgatcctggttgaaagtgactagttcaagacatcaatatgtcgaaattagtgagtaggtaaggagataagattagaatctgacccatatcccctagtcaggaaagtttaagaccatcaccctttccatagcatgaggagttttccgaagttgcctgcgtatattaatactggaaggtgtcatgtagtttatgggggtggggtggaggagagtgagatgaggagacatagtggggctatcatctccattttccagtcactggcctctacttcagtatggaatagcagctaagggagcaagatgcctgtctcctcactgctgtgttgttgctggatgccgaggaaacatcgtagctgggaactcttcagaaaccaagctcctgtcctgccaaagatgttaaccacccaggatggcttctagccaagttacaggggttcagcattcattccacggatgagaaagcatgcatagatgagaataaacaacttgtttaaggtactacagtttttaaatgtggagaagaaagggcactcaataaatgtctgacttggaaatgccaaggaataatgattctatgggctactgactgtaaaagcatccacattttgagagtcccatgggagccaggtacccgtgggaattatctatttgcaggcaggtcggtggcctctctaaccatgctcagtgggcagcactacatctacctgagcatcagtgagtgccctttccccagagcgtggagtctgagaatggccgtccattctcaccaggacttcataattctagtgtcccctcctgtccccacctgggacagtgggtagaaggtcctgtctgccagacatcctaacctcccagataggagactcctacatcctgaacaatgtcttataaaaggacacaaaaaaggtgaggattgtaagctgtagagaaagaaaacaacggcacttaaaagtgctcaggagataggatcaggagaactgctgtttacccactacccactaggcagcaaattagtcccttccagtcagggatatattcatttgcccattcacccattcattttaaacatatttagcaatctcctatgatgagtcaagacaaaggcatgggctggaacatggatagaaaggaactccttcagaagtggtgtggttgaaacgttaagatggcattgactagaaacagaatgtccacatcaaagccaccattccccacaaacgctgcatcccccatacacccagtattaacttgctgtgtaacttcagatacctctctcccctccctgggtctctgttgaatgaaatgaatatttcagacaacatgtcaataatagcttccatttcttgagtcaaaacactgtgctattttatatatatgatttccttaattcttacaagaatactgcaaaacaagtaatcccattttagaggtgaggaggttgaatctcaaaagtattagtaaggtgaaactggaccccggtgtgtctggttcaagagttgggcatcttaactactttatcctctgctgtcaaagttcttaaaggtctcttggtctctgatctgctgccagcctctgcctggctggtaaaacaaaactcaaggagttgaaagagagtggtatcctttcctagactaatctgtgcatccctacccttatactaatggagagtgaagatacataccttctagaaagtcttaaagatcctaaggcctcccgctcttgctacacaaaataggaagtgaatccattgttcctgtatactctgggttcccactgctcagatcataagggctgtctcaatttctccttcctctgggagatgtgagttccaatctctcaggaaggagggagaatttaggttaaggaacttaatcaggtggtgttcctgatgaagtagagagagcagcccttccaaagcagttgctaccactcagctcctgctaagtgctggaaggcacaagaatgggcctaaggttttgagatccttcagtcaccaagtgaggcagaaatgtgaatttctatgtgaaattttccaatttatatatattaacaactgaattcaaaaatataccctgtaggcaagcaaaaacaaaacaaaacaaaacattatgtaggggctaaattctgcctgtgagtttccatagtacaatctctattctctgctctcgttagtatcctcgcttctgagttgcaactctatgtccaaatcactccttctcagtttggccctaactgtttaccacctttgcaaaaattcattcccccattttccaatggcttttcatgtcactcacaggaagagtcagtgtccctttctatcaggctctacatgactttcttaccactgctcctataacccaatttattctagtgctctctctctcaatgctactcctccctattcctctagtgctccaatcacactggtgccagggacctttatacctgctgttccctctgcccaaaaagctgtttcctcaaatattcaaatggcttgcctcttcatctcctgtagatcagttttcatgtgttatctgatcattaagacctttcctgagggccctaattccctcctttgttttctttctcccccattgcaattattatcattcattattatatatctaatatatacatatattttgttcatttgcttatagtctttctgtgctagaaagaaactgctatagaaattgacttgcatatatcttatttattgctttatcttcagtgccttaaatagttcctgacacacagtaggtacttaattaaagcttgttgaattaatgaatgaaaaatagatgaataaatgttaccttatttaacaaatgtgtatggagacttcccaacagatattgagctaaacatgtatcaagaactttaaaacattcagaccatttgacccaataattccactcctgggaatataccctgaggaaataacacagaatagtgaaaatgaatttaagactaaaaatggttgttgatgttgaatacaaaatagcaaaaaaaaaaaaaaaaaagctgctaaaatgtccatcaataaatacattatgaagcagtcatgagatagaattacatgcatgttgaaatacttattgtataatattaaataaaaatgcaagatagaaaacaataatttttcactttcaatatataaaagggaaaagacagaaaaaattagtaaaaagttactgtggctattcaatggggcatacaaaaaattgctaatttatactttactttcaagtgttcactaatgagcatgcataacttttataattaagaaatattagataaaataaggactgatcatacttgtggtagtagtgatgaatttagctctacagtggataaagatatcaaatccagaggcaggctggttctttgtcagaggcattgaggttgagctgtcctggactttctttgtcagtcagttccccactgggtgagctccagccatttcaagggagcccaggacaggaggtacaaagtcccctgactgctgggaaactgcttcagctctgatcaatcagagaacagtcgcttcagcccctgacatttaccaaacctccttcaacctcatctgtcactatgcggtggtactgccttgccagccacagtctaatcaagtcagaatgtgcaagggtccccagagataaagagaaagcggggctctgagggagtagggagaaaggagagacagggagatggaaaaggatcatgagggaggaggggaagagcaaatgttcagagcatgcccgtttgttttgctatcatggcaattaatgctgggaagtgacattttaaggggctctagtgacagctttggtgacattcctgtttgtgattccatgacaaatctctgtctatatcttattttagagagtgtgtagagacagctcagaggatggctatcaggggatgccaagctcctgtctgttggaggcattgctgctgcctgctttgcagagcctaggcatttagacaccagggccaaacgtccaagaggaggcaccagctaagaaaccaaagcaaaaaagccgcagaggcagggtctggtccaggatggccttgtgaactccaccatgtggtacaattaattggagcaaaaaatgaatgctctgccattctacaagtgacatttggtttgtcaatcagtggcaaagaaaaaaaagaaaactcaattctgaatactttccaggctggctagttctaaggagcctattttcaaacacagatattgcctccttgttttctaagaagtcctaagatgaaaattaaatagaaataaattaagctcaaattttacaagctgagaattagaagagattacttaaattgtgtctgatctctccccatgctataccattttgacaaatgtctacctagtcttgtttgaatacttccaaagagtagttcatgatctttcagattaagagggggagagcaatgtagatataacaagttgtttaccaaataatattcaggatgtcacagggataaatacagtgtggcaaaacaaagagagtactgaacttgaacttaagggatgtgggtataaagtacaattgcaccatcaaactctctgtatttcatggatgagtgacttaatgtctcagagctggaacaaggttctgtgtctctcaaaagtgttcaataacacacagtttatcatataatgtttatgaagccattctataaatgttaaagtgctgtataaaataaagcagctattaccgttttatacccttcttaactgtgaccttttagggaaagactattccctattttgctatgtatgtctacattaaacagtcttcagcacacagtgggtgatggtaaacatttgttaaagaaatgaatatgaatgaatgaacaaatgaatggtgaggaagaggtgtacccaaagagaagaatcaggaagtaaatgcaatcctgtctccccctgtggctgtggagatggctaatgaaggaacagaggacacaggacagaactatgagccttcaggacatttaaaatgcaaaattcaaacatcactgggaatagggagaggacagaggcaacatggagaggaaagaggcagtttggtataaggatgtcaaggcactttgatgttaagaaagtcatttctggctgggcgtggtggctcatgcctgtaatcccagcactctgggaggctgaggtggttggatcatgaggtgaggagatcgagaccatcctggccaacatggtgaaaccctgtctctactaaaaatacaaaaattagctgggtgtggtggtgcacacctgtaatcccagctactgaggaggctgagggaggagaatcacttgaacttgggaggcagagcttgcagtaagccaagatggtgctactacacactccagcctggtgacacagccagattcagtcaccaaaaaaaaaaaaaaaaagaaaaagaaaagaaaatcatttccaaatttttcttcttttcatcctagagggcctatgtttcaaaaataatcccacatgcaaccactttaaagcagtcttgcttttgttaaaacaattctgcccattctatcttccccttgccctgcacgtgctcctggcagcaccctcaaggcacagtcaaatgggagctgctgttagtaagggagttccccaggctctctgaaaactggcatctggggcctcagaacagagtatggcttaaagatgggcagtaattcccatgcagggagcagagggcagggtgttgttgttgttgttgtttttcctttccccagggaagatagagcatcgtacagaaataagataagatctgaggcacaaggcacaagaaagggcaggttgagcacatttcataagagcaaatgtggaaatgatgggcccagtggcctatagggttgggtaaaagacacaagtggctggccatagaaatggcaggggtaagacctaaaaccctcatgtgggccttgcctggctcaggtaccatttccagttcctccaccaacccctcaaactgaagcccttgaattatcttcatccttcagatctctgggaaagaaatgtctcctgcaagccacctcagatccagttgtcatgcacctgttcccactgtggcctctggcactttattagctcctctaagaaagaggtttttaaacttaaggttatgacccactctcaaactgtgaaatcaattcagtggctccatcagcattacaaaaatgccatcaaaagaatagaagctatcagaacatggtcccatgtaatgacaatgtgtattattttgcaaaacttattttagagatgtgcgcacacacattcacacgtgaatatgtgcaggctcactgtataaaacatagttttgattatgtctgctgttcaacgttgtggataaacatagctctaagagacttagcttgctgacatctaagctaatgtctttcctctcctgctcatataaatggacaggagtaatacatgttgtgttatctccagcacatgcttggacttgggtatcagataaagctgggttcaaattctggttccattatttgtagttgtataaatttgagatgatatctagattttgataaggataatacattctttatgagatagatgcaaagattcaacaaatcattgacttgaaaatgctaaacaagatttgtccagtgcagagaaaagacaaagaacacatagaggttaccaatcagtggaaagactaaaatatccatcagtccattcattcattcattcattcattcactcatttattcctctatccactgacccagcatatttattaacacctgctatgtgccagggattgttttaagcacagaacaaacttggtactgatctcatggaaccttcagcctactaagataattaaaatacttaacaaatccaaataataaaaagtactattacaagaacaaatagtaaagttgacagaagacaaaagagaggaactcacatagagaaaagaggtttgtctgaagaaatgagatttaaactgagatcagaatgatgagagagagccatccatgccctgacagattggggaaggaaagagggtagttttccaggcaaagataatcatggcacatacaaagggcataggagaagaaggttagcaagtctgaagaacagagaagaggccattgtgtctggagcatggagggcaactttaagttgggactgttgtgactggagtgatcacaacagagtggctgcagtgtggagaagggaggaagaggatgggataaaagcaggaagaccaataagtaggtatgtgaggatgaggtaattgtggggatgtcaggaagattgatgtggcttgaagaggaatggacggtcatagggtgggaagcaggggtgaaggcgaggagtctggaaacttaggctagagcctcattgtgaagaagcttgaacaccaagataagacattgaataaggtgttgactctgaaagagctctgaaaattcatgaaatgctacacaaagatgaaatttacatgacattcacagggggtgtcagaagggtgagttaacaaacagcttctctgtttctgacaccctagagtgatctattgacaccaaacatgagttccctgcacccttggggaccactcgaaacactcccaaacaataggatctccctgctgcaaagttccttctgccaatttaggagctcagaattactgtgtaacagcttccttcttcagggaacacatgttgattacctattttttattcccagatttgtgagtgaagcaagcccatggttgctgtgcattagctctccctaagcttttaagagctcattgccgtcccaaggattacgaacctcagtgtggtgtagtgagttcaaatcccagctctgcatcttactacaatagctctcatgttggagttttcacctgactcagccatactccagctgtgttaccttgagcaagttacttaacccctctttgctttggtctcctcctctgtacagtagggataacattagtacacacctcatagggttattgtgaggtataaatgacacaattcatggcaagttcccagaagagtggtagaaatcagctgttgtcagcagcagcagcaacagtatcctagcctaatcaatccttccatccatcttctactcaggattaattacaaatggcttaatgaggtaatgtacaggacagcagctggcttccccacaggcactcaataaaagtcccttgtccctttctaccaacaagcattccattcagatttcttggactgggatcctgagaaatagcaaggttcagtctactggtcccatgtcccagagatcacaatgccttcctatctatcactgtcggccattgctggtatttaagggtatatctctcttctgcctccaccctagattctaaactgaggcaggagagcagagaaaagcttgcatactgcacacttcaccaaaagaatcatttttcatggtaactatgaggactgatattttacaaaggaaggcatttggaccaatgttaactgagggaaaaaaacaaacaaaagagaaaattatgcatataaaatgataacaacgatatagataaagaccagaagcacccactataatataagaacagtcagtttgatggggtagtgggttgtttgtgtagatctgtgtagaaaagcatacccagctccccttgagagaataaaacagactttttaaatggatatgccagcatttatcaaactttcaaatgcatgtgccttctgatgctgtgattctgatttttggtacacatctgtcctacagaaatattctcatgctttacaagaatagctagctaggtatacgtacaaagatgtttgttgacccatcgtaagtgcagaaaattaagataatggtcggatgtgagggcaatctggctgtgacatctgtcaccccattgatcaccagggttgattcagctgatctggctggctagatgggtgtcctcttcctccctcaatgctccatgtgcatccctcctgaagctgcgtgctcggttgaagaggataaccatctctgacagaggatgactggtctttagtcaagggtatatgagtagctgcactaccctaccagaacctctaaacaagctctcaagataatggtcaacaatagagggttgcaaagtttgatatatttggtatgttcttagcatgtgatccagcagtacagacttcagtgggagtaaggtaagtatgcatggctgacttgaaaagatactttctatatacattgcttaataaactatcaaattgctgcagaatgatatatgtggatgagataaccccactgactccattaatatatatgtaggtgcaagtgtgtgtgtgtatacacaattatatacactgatacacacacatccatatacatatgtatgtatgttatggctatattggaaaatgccagaagaatataaattaaataaaacaatatattagcctttgggtcctgtcagtggaatagaatgaacaggcaagggtagaacatttagttgttgctttatataatacaaacttctttttttgtctgaaaggtctttatttcatgttaattattgaaaaatattttgctgggtacagaattatagattggtaatttttttcctataagcactttaatgatgtaattccattgttttctggctttaataattgctaatgaaaaattagttgtaagtctaattttcttctttgaaggtaatgtatctttttcttctggctgtttttaagattttttttctttgtcctttgttttttaactgcctgaataaaatgtgcctatgtagtttttttttcctttatttcttctaaacaaaaggggggtacatacacagaatgtgcaggtttgtcacataggtatacatgtgccttggtggtttgctgtacctattgagtggtcctctaagttccctcccctcacccccaaccctccaacaggccctggtgtgagttagtcctctctctgtgttcatgcattctcaatgttcaactcccacttatgagtgagaacatgtggggtttggttttctcttcctatgtaagtgtgctgagggtgatggcttccagcttcatccatgtccctgcaaaagacatgatctcattcctttttatggctgcatagtattccatggtgtatatgtaccacattttcttttccttttttattatactttaagttctgggatacaagtgcagaatgtgcaggtttgttacataggtatatatgtgccatggtggtttgctgcacccattaccacattttctttatccagtgtatcattgatgggcatttgggttggttccacagccttgctattacaaatagtgctgcaataaacatacatgtgcatgtatctttatagaatgatttatattcctttgggtatatacccagtaatgagattgctgggtcaaatggtatttctggttgtagatccttgaggaattgccatcctgtcttccacaatggttaaactaacttacattcccaccagcagtgtaaaagcattcctatttctccatatctcatcagcaactattgtttcctgactttttaataattgccattctgactggcattagatggtatctcattgtggttttgatttgcatttctctgatgatcagtgatgttgggctgtttttcatatgtttgttggctgcataaatgtcttttgagaagtgtctgttcatatcctttgcccattttttgacagggttgtttttttcttgtaaatatgtttaacttccttgtaaattctggatattatacttttgtcagatgggtagattacaaacattttctcccattctgtaggttgcctgttcattctaatgatagtttcttttgctgtgcagaagctctttagtttaattagataccatttgtcaattttggcttttgttgcaattgcttttggcatcttcgtcatgaagcctttgcccatgcctatatcctgaatggtactgtctaggttttcttctagagtttttatggttttgggttttacatttaagtcttgtttccatcttgatttaatttttgtataaggtgtaaggaaggggtccagtttcacttttctgcatatggctagccagcaccatttactgcagagaagattctttccccattcctttttttgtcagttttgtcaaagatcagatggttgtagatgtgtggtgttatttctgaagtctctgttctgttccattggtctatatgtctgttttggtatcagtaccacgctgttttggttgctgtaggcttggaagtagcatagtttgaagtcaggtattgtaatgtctccagctttgttctttttgcttaggattgtcttggctacatgggttcttctttgactcatgtgaaatttaaagtagttttttttttctaattctgtgaagaatgtcaatggtagttcgatgggaatagcattgaagctataaattacttttggcagtatggccattttcatgatattgattcttcctatctctgaggatgaaatgtttttccatttgtttgtgtcctctcttatttccttgagcagtggtttgtagttctccttaaagaggtccttcacatcccttcttagctgtattcctaggtattttattctctttgcatgggagttttattctttttgaatgggagttcattcatgatttggctttctgcttgcctattcatgtaaaggaatgcttgtgatttttgcacattgactttgtatcctgagactttgctgacattgcttatcagttcaagaagttttggggctgagatgatggagttttcttttttttattattattattttttaaattttattattattatactttaagttttagggtacatgtgcgcaatgtgcaggtttgttacatatgtatacatgtgccatgttggtgtgcttcacccattaactcgtcatttagcattagatataactcctaatgctatccctcccccctccccctacccaacaacagtccccggtgtgtgatgttcgatggggttttctaaatataaaattatgtcatctgcaaacagagacaacttgacttcttctcttcctatctgaataccctttatttctttctcttgcctgattgtcctggccagaacttataatactatgttaaataggagtggtgagagagggcatccttgccttctactggttttcaaagggaatgcttccagcttttcccattcaatatgatattggctgtgggtttgtcataaatacctgttattattttgacatatgttccatcaatatctagtttattgagagtttttaacatgaagggatgttgaattttatcaaaggccttttctgcatctattgagataatcatgtggtttttgtctttagttctgtttatgtaatagattacatttattaattttcatatgttgaaccatccttgcatctcagggatgaagccgacttaatcatggtggataagttttttgacgtgctgctggattcagttcaccagtattttattgaggatttttgcatcgatgttcatcagggatattggcctgaagttttctttctttgttgtgtctcttcccagttttggtatcaggatgatactggcttcataaaatgagttaggaaggagtccctccttttcaattgtttggaatagtttcagaaggaatggtaccagctcctctttgtatttctgatagaattcagctatgaaaccatctggtcctgggctttttttttttttttttttggttggttggttattaattactgcctcaatttcagagcttgttattggtctattctgggattcaacttcttcctggtatagtctttgtagggtgtatgcatccaggaatttattcatttcttctagattttctagtttatttccatagaggtatttatggtattctctgacagtagtttgtatttatatggggtcagtggtgatatcctctttatcattttttattgtgtctatttgattcttctctctgttcttcattagtctagctagcagtctatctattttgttaattttttcaaaaaaccagcctctggattcgttcagtttttggagggtttttcatgtctctatctccttcaattcttctctgattttagtttgctcttggctctctagctcttttaattgtgatgttagggtgtcaatctgagatctttctagctttctgatgtgggcatttagtgctataaatttctctcttaacactgctttagctgtgtcccagagattctggtatgttgtctttttgttctcattggtttcaaagaacttcttgatttctgccttaatttcattatttatccaggagtcattcaggagcaggttgttcaatttccatgaaaatgtgtggttttgagtgagtttcttaatcctgagttctaatttgattgcactgtggtgagagagactgtttgttatgatttcagttcttttgcatttgctgaggagtgttttactttcaataatgtggttgattttagaataagtgtcatgtggcactgagaagaatgtatattctgctgatttggggtacagaattctgtagacgtctactaggtccacttgatccagagctgagttcaagtcctgaatatccttgttaattttctgtctcgttgatctgtctaatactaacagtggggtgttaaattctcccactattattgtgtgggagtctaagtctcatcataggtctctaagaacttgttttatgaatctgggtgctcctgtattgggtgcatatatattcagaatagttagctcttcttgttgaattcttcctgttaccattatgtaatgcccttccttgtcttttttgatctttgttggtttaaagtctgttttgtcagagagtaggattgcaatccctgcctttttttgttttccatttgcttggtaaatcttcctccatccctttattttaagcctgtgtgtgtctttgaacatgagatgggtctcctgaatatagtacactgatgggtcttgactcctcaaccaatttgccagcctgtgtcttttaattggggcatttagtccatttatatttagagttagtatcgttatgtgtgaatttgatcctgtcgtcataatgctatttggttattttgcacagtagttgatgcagtttcttcatattgtcatcggtcttcatattttggtgtatttttgcagtgcctggtacgagtttttcctttcatatttagtgcttctttcaggagctgttgcagggcaggcctggtggtaatgaaatcccacagcatttgcttgtctggaaaagattttctttgtcctttgcttatgaagcttagtttggctagatatgaaattctgggttgaaaattctttaagaatgttgaatattggcccccaatctcttctggcttgtagagtttctgctgagaggcccactgttattctgatgggcttccctttgtaggtgacctggcctttctctctggctgcccttaacagtttttccttcattccaacttggaaaatctgatgattatgtgtcttggggttgatcttctcgtggagcatcttaatcatgttctccgtatttcctgaatttgcatgctagcatgtcttgctaggttggggaagttctcctgaatatatatcctgaggtgtcttttccagcttctttccatttttcctgtctccttctggtactccaatcaattgtaggtttggtctttttatgaagtaccacatttcgtgcaggctttgttaattcttttttgttcttttatctctattcttgtctgcatgtcttatttcagtaaggttgtcatcaaactctgatatcctttcttctgcttggttgatttggctgttgatacttgtgtataattcactaagttcttatgctatgtttttcagctccatcaggtcatttatcttcttctctaaactggttactctagttagcaattcctctaacctcttctcaagattcttagcttctttgcattgtgttagaacatgctcctttagctcatcatggttttttattacccatcttctgaagcctactctgtcaattcatccatttgatcctctgtccagttctaggcccttgatagacagatgtggtgatcatgttgaggagaagaggcgctctgctcttttgggtttttagcattttttcattgattatttctcatcttcatgagtttgtctagttttagtctttgaggctgctgacccttggatggggtttttgtgggggcctttgttgttgttgttgttgttgtggatgatgctgttgttgctttctgcttgtttgtttttctttcaatagtcaggtccttcttccgtagagctgctgcagtttgctgggagttcacttcaggccccattcatctgattcactcctgtgcctggagatgtcactcaaggagtctggagagcagcaaagatggatgcctgttcctacctctgggacctctgaccttgagaggcaccaacctgatgccagtaggttcgctcctgcatagggtatctgacaacccctgttggagggcctcatccagttggatggcatggagagaagggctcatttaatgaagcactttgtgccttggtggagagggtgtgtttttctgaggggaaacccactgttctgggctgcccggattcatcagaactaccagaaggagaggctaagtctgctggtccacagagaatgtggccaccacactccccaggggttcaggtccagggagatctgaattctgtcccagagcctctggctggagttattggagatcctacagggaagccccacccactgaggaaggatgggtcagggttacacctgaacaggcactgtggccgcctactgccattgccggtgtgttgggctgtggggacaagtcttgggaccaagctgtgtagcctccctggctccacaaaaatttttgtgtatttttggatttttagtagagacagggtttttccatttcggccaggctggtctggaactcctggcctcatgtgatccacctgcctcagcctcccaaaggctgagattacaggcatgagccactgtccctggctgccttgatttatcttgattgatcaactgatggatcaatcacttagccaacaggcattttcagagtgcctactatgaagtgttagccactatgctggatgctacaaaaacaaagataaaggacactgtactctctctcaaagatctctaagtctagcttagcagacagaaagagaaactgattatttttgtacagtgtgggaagtggtcagttcaaagtaatcacaaccagctttaagagctggaagagggagtagattactcatttgggttgggttgaggaagataactgatgtagaaactgattaggggctaggaaaactcctccagcatttggagttcatttatcattggatacccacagcaaatctatgacctgggaagactggctgttaaaaaaaaccaaacaaacaacaacaaaaagaaaataaaagcattttccatataaggacagcaatgctcaatgagttatgctgcaaaagccaaaactaaaatatataggaagatgttttctgccttatctaagtgattttcttttagacaaaggaagcatgatgttttggcctgctggtattactgccaaatgaacatccttaccctttcaaggccatatttattgtctgaccttcactgggcactgtctatgtgggaggcactgtgctgggcattgcaggatacagagaaataaaataaatgcagactgtccttgttgtaagatgagaaatcacatgaaaatgataaataacatttgagaaggcaaacaaatgggggtagtgacaataaaccagcagttcaaacacagaagagcctatgatggacaaggggaatattcaaagcattccagagcagtgagcatatcatggtggctagagcttgaaggaaagctggagataaatattacagctggatttgagagaatctcagaagtccagctaaaactgaaggactgaggtctacacatacacatcttggggttcaagacttaccacgtgccaagtcatggggtaggtattttacacatcttttatttttatatctaatcctcccattaacccttcaaggaggaaactgaagccaagagtgttacattcccagtttcccaagatcacactataagtaaatgggacaagatttgaacccaggtccagatgacttcaaaatctatactctcatctacattatcactctactttctccctgagtttctaggattgaaaaaaaaacctactttttaaaaagccccccgactttttctgtttgtccactgagcatcaaggaaagatgggcctcagaggagaatctcaggagtagaaaagaagaatgcagaacccagagctccagggaaggggccaaactaaaaaataaggctttctttaggctctcaaaagtagcggtcggtgtctgaaccgggatctccagcccaaagctttcacccgttatcatcatcagcctcacaaggaatgaagagataaagaagaactgtgcctttgttgcatttgtctaaaggaaaatagctaaattccatctgtaaacaagctcaacgatagacagtaaaggcaaatgtaaacacatcctgtgcttatgtccaaataatcaattgtccccaaacaaaacaaaggaaatgggtctttgcaacaacatatgtgaaaaggagcaagaggtattagtcatcaaaaagtccaatgtgaggggagtgatgtcagcaagatgcatgataagagacacctggcatttatattccaacaagaaaggaccaaagcaatgaataaacagctaggatttgacctgagtgtcgtcgaaggcagagcaccgaaatgcagcagaagagtggagaagcatctgtggtgacaggaagtccatgagggcaatgtagagtcacccagcctctgaagcaccatccccctggcctggattagatttgcctagagtcaggagaaacttctcactgtggggaaaagataagcagaagatctctatccgaccccattgctaccacaaacacctacagtccctactacaggagaattccacagtcctcacaagccctgagcccagtttaaagagccaccaagaatttatacagctgcactgtcctggattagaagcacagcatgtgtacttctcacttccacccaccatgtgagccaagttgctgcagcacggtacacacctcatgagtgtgccctgctttgggggccaatagccatggcacctctccagcaatggggctccatcttcattaccccaagcccacacgggtggctgaatgtcacaagcccagctttacagagcttgggcctaaaactggctgtgactcttgtcctacagagcagagaaaccaacccccactaccctacttccagccagagaaacagtataacggtcccacccacagctatcctgccttgagccagccaaaccactgctcacccaccctcaagtgggagaagcctctgagcctccaagcagctgatataactccagggcagcagaatggctgcatgcctatgcacaggacctgagaactggctccagagtgcccccacccactacagatatatccctggcctgcctaatagttctacgccccctaaaagagcatgagaaactgtcccacaggacagccctggtgggcataccaccagaacagccaagcagccaacagcccatgtcctgaacctgaacagccccatcagccactccttgtggacattccctaggctggccaggcagctgcgcacctacataccaggcatgaaacagccctgcaggctgctcctggtgggcacacacctgagccagccaagcagccttgtacttatattccagacctgagaaacagccccttgggcagatatgcccacaggttggatgagcagctatatggccatgtcccaggtccaaaagagtcctgtgggccaccacccacagaaacgccccaaaccagccaagcaactgtgcagttatatcgtgggcctgacaaacagccctgtacccacccatggtagccatgcccacccaggctgttcaggccactgcatgcccatgtctcaagctggagaaatggccctgtgggttgtccccctcagacacattttcaggccagccaagcagccatacacccacatagcaggcctaagaaactgtttcaaaggcagctcctggcagatacacacctagaccaactgagcaaacttatgcccatgtcccaggcctaagaaacatccctatgagctgcccctggtagaaatatccccaggccagctgaaaagctatactcccacattctgagcctgagaaacatccctttgagcagctcctggcaggtacgcccccaggccagctgagataccacgtgcccttgctcctggccagaggaacagccccatggccctaatatcagggaatcagaccccaagctgcatgaacatccccctgttctgagaaatagcccagtgagcccaatcctggcaaagctgcaccaccatcaccacaaactctctcagcctaggtcactgagtatcttacaaatgtcactaatgtaaaattgtagccaatttaactacatagaaactctagtattgcatctaactaaaatccaggacagcacaacacaccaaactaacacctcaagaccaagttatacaaataagtctttccttatgaaacctactcaataaaatcagaagtaataatttttctaccacatgctaagaaatcaacatagggacacatcaaacatgaaaaatcaaggaaacatgtcactgtaaaaggaaaacaataatttgctagcagcagaccctgatcataataaaatacatgaactgccaaaaaaattaaataataattttaaataaactcagtgaggtataagagaagaaagatagtcaatttaactatatcaagaaaatgattcatgatttacatgatacattcaacaaagagatagataccataaaaaagaaccaaacaggaacaaagagctaaagaattcaatgaagaaagtaaacatatgaatcaagagcttcaacaatagactagggcaagcagaaaaaaaaatctaaacttgaagacagatattttgaaataacacaaggagtcaaaaagaaaagaaaagaaagaataaataatacaaaaaaaagaaagcctcaagtaagtgaaaaatattcatattaggggtgtttcagaagaacaagtgaaaaggtgatgaaaatatatttaatgaaataatagcaaaaaaatattccaacgtcttgggagagagatggacatcaaggtccaggaaaccagataggttaaacccaaacagatcttcttcaaggcatcttacagtcaagttgttgaaagtcaatgacaaaaaaaataaataaacaaaatcagcaagagaaaaaagtcaggtcacataaaagggaattttcattaaagtaacagtggatttctcagccaggagagaatgagatgacatattccaagccctgcaaggaaataactgtcagtcaggaatactgtacctagcaaagttatccttcagaaatgaagaagaaataaaatctgttacaggcatatggaaactaatggaattcatcagcactaggctggctttacaagaaatgctcagtgaagtcttacaactggaagtgaaaagataacaactatgatcatgaaaatatgcaaaactatacaactcactggtagagccaatatattttttgaaagagaaaggaatcaaaccttatcactacagaaaaccacccaactgcaaaaataataagagagaaagtaagaaacaaagaatacacaaaacaaccagaaaacactcagtgaaacactgattagttcccacctatcaacaataacaattattataaatgaactaaattccccattaagaatatataaacaggacaaaaggatgaaaaaataagacaaaactatatactgcctattaggaaattcacttttcctgtaaagacaaacatagaatgaaagtgaaggaacggaaaaatatactaaatgcaaatgtaagccaaaagtgagaacaagtagctggaattatatcagactaaacaggcttcaattcaatgctgtaaaaatagacaatgaaggatattatatgataataaagagatcaatacagcaagagaatataacaattgtaaatatatttacactaaacaccagaacatcctgatacataaagtaaatattactagatctaaagggagagacagactccagtaaaataataattggggacctcaacattttattctcagtattggacagatcatctagacagaaagtcaacaaagaaagatcatatttaaacttcactatagaccaaatggatgtgatagacaattacataatatttcacccagcagctgcaaagggcaagattcttttcatcagcacatgggacattctccaggattagccatacgttagagcacaaaacaaatctcagaaaattttaaaacactgaaattgtatcaaatatcttatctgaccacagtggaataaaactagatatcaatgacaacaggaatattcataactatacaaatacaaggagattaaataagatgctcctgaatgaccaatgagtgaaggaagaaattaagaataaaatttgaaaattccttgaaacaaatgaaaacagaaacacagcataccaaaatccatggaacacagcaaaagcagtattaagaggcaaatttatagtaataaatgcttatatcaaagaactagaaagatttcaaatcaataacctattaatgcacctcaaggatataggaaagcaagaagaaatcaaaccccaaattagtagaatgaaagaaatagatcagagcaaaaataagcaaaaagactaaaaggaacaaaagatcaataaaacacaaagttgttttttaaaagataaacaaaattgatgaactaatagctagacaaactaagataaaaggagagaacactcacataaataaaatcggaaatgaaaagggagacatcacaatggatatcacagaaatacaaaatgatacaaataaatacaaagtcaaaggctattatgaacagctataggtcaataaatttgaaaacagagaaaatggataaatttctggacacacagaactcaacaaaattgaaccacaaagaaatggaaaaccttaacagaccaaaacaagtaatgagactgagtcaataataaaaagccttccaacaaagaaaagtacaggaccagatggcttcaccactcaattctgctgaatgtataaagaagaattaataacaattctcccaaaactatttcaaaacattgaagcagagggaattctttctaattcattctacaagacatgcatcaccctgatactaaaaccaaacaaggacacacacacaaaaagaaaactacaggtcaatatccctgatgaaaatatatgcaaaaatcctcaaagtactaaaaaactgaatccaacatgtcaaaaagataatacaccatgatcaagtggtatttatcccaggtatgcaaggataatatatgcaaatcaataaacatatttcacatcaatagaatgaaggacaatcaatagaatgatggaaaaaaaaccatatgatcatctcaaagcaaaaaaaaaaaaagcttttgaaattttaaatatctcctcgtgataaaaactcttaataaattagtcacagaaagaaaatacctcaacataataaaggccatatatgacaaatccacagctaacatcttaccaaacaagacaaaaatgtccactctaatcattcttgtcaaacacaatactagatttcctagccagagcaattaggcaacagaaagaaatgacaaacatccaaattggaaaggaggaagtcaaattctcttatcttattcccagaaaaacctaaagagtctacctaaacgtcttagaaatgtgatatggtttggctctgtgtcttcacccaaatctcatgttcaattataatccccaaggttgggggagagaactggtggtgggaggtgactgggtcatgggggtagatttcccttttgctgttattgggatagtgagtgagttctcacgagatctgtttgtttaaaagtgtttagcacttctcccattgctctctctctctcctgctgtgccatgtgaagaaggtgcttgcttccctgtcgctcttttgccattactgtaagtttcctgaggcctccccaaccgtgcctcctgtatagctgtgaaattgtgagtcaattaaacctcttttctttataaattacccagtctcaggtagttctttatagcagtgtgagaacagactaataactaactgataaaaaaattcggaaaagttctaggatgcaaaatcaacatataaaaattagaagcacttctatacataaacaaactagctgaaaaagaaaccaagaaggaaatcccatctacaacagctataaaacaatacaataaaatacatagaaatcaatgtaaccaaagaggtaaaagatctctacaagaaaaatataaaacattgatgaaagaaattgaagaggatacaaaaaaatgaaaagacctcccatgctcatgcaatcttgagaaaaaaataacaaaattggaagtatcacactttcagacctcaaaatatactacaaagctgtagtaaccaaagttactgcaaagtaaatgcagtatggtactggcataaaaacagacacatacatagatgaatgtaacagaatagagaacccagaaatttatttacagtctactgactttttacaaaggtgccaagaacgcttagtagggaaatggcagtctctccagtaaatcatgctgagaaaactgaatatgcatatgcagaagaatgaaattagacccccacttttacccaataaaaaattaatttacaatgaatcaaagacctaaatgtaagacccgaaatgataaacatattagaagaaaacaggggaaacacttcaagacattggtctgaaaaaagattttgtaagtaagaccttaaaagcacaggcaaagaaaaaaaaagcaaaagtagacaagattatatgtcaaactaaaaagctcctgcacagcaaaggaaacaacagaatgaaaacacaacctacagaatgggagaaaatattcataaaatatttatccaatagggaattaatatccagaatatacaagagactcaaacattccaacagcaaaaacaaaaaacaaaaaaacaaaaaacaaaaaaaccctccaatctaataaaaaagtggacaaattgttctgaatagaaatttctcaaaagacatacaagtgaccaacaaatatacgaaaacatgctccttattagtaattatcaggtaaatgcaaatcaaaaactgcaatgaggtataatctcatctcagttagaatggctattataaaaaagtcaaaaataacaaatgctggtgagaatgcggagaaaagaaaactcatacactgtcatgcgaatgtaaactagtacagtcactatatagaacagtttggaaggtcctctaaaaactacaaaaagaactaccatatatctagcaatcccatgacttggtatttatccaaattaaaggaaatcagcttattgaagatacatctgcacctgcatgcttactgcaggattatccacaatagtcaagatatggaatcaacctaggtgtccaacaacagatgactagataaagaaaaggtggtatgtatacacaatggaatacattcagccataaataagaatgaaatcctttcatttatggcgaccttgatggaactgaagaacattatattaagcaaaataagacaggaatggaaagttaaatgtcacatattcttattcacatgtggaagctgaaaataattgacctcatagaagtaaaagaatgctcgaggctgctagtaggatacagaggatattagaagctgggaaaggtaggagggagacaggaatagggagaaatttattaaaggaaataaaattacagctagataggtgtaataatttctagtgtcctataccacttaaagattacttattaatgtaatacatagtttcaaataactaggagcttattgaacattcccaatgcaaagaaatgatcaatgtttaagatgattgatatactaattaccctgatctgatcaccatatatcatatggatcaaaatatcactatgtactccataaatatgtacgaacattatttgtcaatataaaaaaacataaaagaagtctaatatgagccagcaataactgtaacaaacaaatgggatctcaagctgcatcaatagaagtataacagttggcaagaaggagacaaaaatcccatttttctcagccctggatcattcctgccttgaggaagaagagtgtcagtttgggtgttatggcccaggatgtgaaaaattagaatttctgtctagacggcagtgaccaggaaggtgaaatgtctgaaaaatgctttatatgagactatttagagaaactggggtgtttaggttgtttaaaatgtacagtctcttttatttgtgttgtcaaatttcccaagagctgctgccttggaaaaagaatatcagatcactttccttttggacatgggggaccgtgaacacagatttcaagttggtataagaagaaaccctctaatagtcagtaattgtgtggaaatgagatggcctcttttccgagtagtgagaaagctgtcaaaggaggtaatcaagagacactggaaagatgttggactgcatagcctctgaggctcctcacaactccaattctgggagtactgacactcttttattctctcatcactactgaagaatcagagaagacaaacttgataacccaacagaaatctaaagccataaatccaaagtggcttatcccagaaaacactgcctgtagtccccaactgcccagcttctgcacctcttcccatcttttcaaaatgccccctggaaaatgggctgtgacatggaggactcacctttcttctcaaagtccaccttctcttcccctggatgtcccagactgtccagagtgtgggtcacctggctgccaaactcgtcctcgcgggagacatggttggcccgcctaggtggctcctcatcctcctcacagtcatagtcatccaggatgggagtctcccggatgggcacgccaatgacggaattgtgggtttgcagccgggatgaacggaagctctcccgcgcctggggacccagcagcacagatgggatgtagtggatctcatgagtggcttctgtgcttgcgctcttctgggggatgcggcgacgcttctgccaacgtcgctgggcgtacagcgccacggtgaacaccagcagcagcagcagcagcgcgatgaggccaccctggagcaggaaggaaggacacacaaatgggccactgttctttggaatcgagggctgcaggggattttcctgtccactacactctgccaggatccctgggtttggctcatagagcctcaggaaccaccagccgtggtttttaagctagagagacattgtttcaaacctggctttttcaccaacaaactatgtgaccctaggcaaacttcttcacttctctgagccttgctttccatagttataaaggttgagtaggaatccctgctcttccttcttcacaaggttgccataggaagcaaatcagatggataacggtcatgtcagagcaatacagatagctcagtggcaggaagggtcagtgctgcggcttcacacaggtgaatgtctgaatctagactccatctcccaccagctgagcatcccaaggacagttgcctacgctcccccagccttgcttcctcatctctagaatgagttaactgaaagatcatgagacagtagtaggctgtcttacatcttgctgcaaatataagatagcattattaaatcaaacataatgtctgcatagtctgtattttcttcatttttcagaaacaccagtctttaaatttctgaatttctataagggaactgggacaaagtaggtccttaacaaatatttggtaaatgagtgaatgaaaatgtacctttctagggctcctttaataagaatttcaaggtcaactgatatatatatatataatgtgtatatatatacatttttttctttgatacactcagctcctaaatatttgagtctgcattatcctacattaatttgaaataagctaatgtgttaatgcacatatcttacatgattcatgaaatactctggtctgtaagatccttcagggcagaggtattttcaaaacacgtctgtaatccccataacacctgtcatgagcttgaagttgagggtttgcattctccaggcctcccctcaattgttctgtgccagaaacctctcctctgatgggtaggccctcatcacttctcttgcttttcttcactttatactctgcttcatgtttgggagattggaagacactttgctgaatgcctgctgtgtaatccctagagtcaggaggaatcacccttgttgtatacagggtagagagaggcttcaaaaaatcaagagacccagaaactcagagagcaagtggcagagtaatatctgagccttactttttgtgtgtttattttgtttgtttttgctttttaactctagagcctatattctttcaatccacctgtgtggttgatggcttctccttggctatgatctcattgaaggcaaggacaaattctgacaactatctgtacagcatctaacaaagatgacagatgttagctgtgaatacattatcttaggggcaaaggtggctgctgttaaacacacctgtttagaccaagaagaacactgtttgctgaaatgggtcagccatcctgctgactgtatttgatattagaaaactggcatgttctatttgcaagaccctcagctcactatgctgaaattcagcacctccacagaggtagggggactgggtggataagaggactaagaggtggtggccaggtatgcaggtgtggctgatagctctgtagcaggggcccaagccctgccttgagttcagcagtgagctactttggtttccccaagaaagtttctctggatgtcataacataaaaacaaatgcacaaatcaagcaaagctataagtacgtgtatttatgtgtgtatttgtgtgtgtgtgtttgtgtgtgtgtagaatctattaaatatatgtgtaaatgcatgtgtataccagaggtgattatgtatatatcaccttaaaaaacaacaatgaatcttttttttcctctacagaacatatgatagtgattgctttgtgtcacaaaattatgtgtgacatgatattatttgtctgggatttttttgtgtttcagaaataagaaaagaaggagagggagggagtgaggaagagtgaagaggagagaggtgatagagagggagagtgaagagaggaaagggctgggggcaacactaatccttgataaacacaagggctgaccctctccttaacacctttactgaatgtttttttatttaatctttaagacaagactatgtgacagaaattagtttatgctgtatagatgaggaaaaggtaactcagagaagtaagtaactagcttgaagtcacacagtcaggatttaattccaggtccagctggattcaaagggccaggaagtggtggagctgtgactgggccccagctccccatttcacagcccttggttactgaacggcaattctcactgactaaagagagggaaggggaggaggaggaaagatggtgagggtgcatgaaaagggaaaaggaaagtattattttcaaattcagcctccagatgtgcaatgggtgcatcttctcttcagagaagattttcattctggcccattgatgcccctgggggaatctccttgcctgaccatgccctctgtcttctcaactttgggcatttcattcagtgagaggataaggtcttacatggttcctgggccttcattcctcatcccactcagtatatcccgattatggttgtgggactctgtggtcagatcccaggaccaatactgacctaggaaagatgaggcctaaccaacccatccacctgcaactactaatgccccttcttccttccttgtatcctttgccttgagagccttccagtagtaaatggctaagtgttggcatcagactgacatgattttatccaggttctactgcttagacactctgtgaccttgaccagtttattttatctttctagatctttggctttctcatggattaaacaaggacaagagtcataatgccacctcattgggtcatgaaggctaaataagatgcttgtggggtatttaatatagggtaggggcacatagtatcataggttgttagctgctgttactgtcaacagaattcagcaagtatacattctgtgttgaacgaataaaggaatgaatgaaggaatgaatgacttgagtttctggccctatatacctattctgcacaacttgccttggatccccaaatccttttcaatctggaccaaatgtttgatatgtgctctttcattcacctttacacctatcatcatcctacattaagttggaaactcaggcatagagacaaacgtcatttactcaagatagagcagctgagattcaaactagctccagcatgactttaaaaccatgctcggagtggagaaggcacaggagcaaaagcctacttagcccctgctcagtctcacttctgccttatcaagttacctacacaatttcaggcacagatttctcaacataggaaacttccagaagaatgtggcagagggaccccctggtttgggaggcactgagcttgaggttccctttagtttattgacccattgattctttagcccttgaccttgccatttgatatgagcccaagccagtggctatggctatccctttagggcacaggttcattgtcctcactccccagcctgccctgaactcagcttccatcacctccaactgagtcactgaccacgtggtttccgttacagattcaagttttattgcaagaacttggtcaaagcagatttccagtattctggggctcatcgtgccactgactactgaaacagacatcccaggctgggcttctaaagaactcaggaggcatcatctaaaacatggtagcagcttaggtaacgttgcaagcaccaatctgaacatccctccctccctagaccctgaaaaagtagtggaatacataaaattggacacagtctcagagcatgtgggaaaaagcttctaaattcaagtttacttactttctgaccttggcttgctcctatggaccttcagtttattaatcagtaaatcggagttggccaatacttgtaatactatatcacacagttagaactagctaagactgggagtcagaaacacaaggttgaaatctaatgctgcacatataagctgggctatcttggacatagaacttaatttctctgattaacaattttattatctataaaatcaggtcatagacttctttatcaagggaagtgagatgtgaactaatggacacgggatactttgcttagtgcctggcacatggtaaaccagtgataggagaaaatcttcattcatggtaccccctataggctgctgtgcaaatcaaatctgaaaacagctgtgatatcctgtaaaaactgaagagtgccgtgcacaagcaaaggagctcaagagaaccatctggctgcttctgtcatagtgagacatctcacccaaagaatgcagatgagtgactcagaatcaagaaggaagtgtagactgtgtccacctgcactggtccaggcttctgtcctggtccacacccatagaattacatactcccttctttaacagcttcccacaccagaggtaagcaaacagaaaggcaggagcaatcgaccagtgctcagcacggccagtgtgtccagcctctgagtccacaccaggagcaaacacaggcccaagcagtggaaaaaaatgctgcacggcaaaaggggagctgaggaggaagaaaaagacctaggaagatggctgtgaatttttagaaagcaagttaagaagaggcgaaatctccaagggtgacaagctgagaccctgctggcctcagggacgatctgatgccaagtccgatttgtaccgtgctcactccagggcagccctaggcaaacaaggctgaggaagtcactgcaagttctagaaataataacatcagtctattagttacagggttgcttctgtgaggttgtaagctggacagatcttggggtgatttgtttttaccatcaccttatgagaatttcaagaagctttcagggaggaagtggagaagagatgtgagaaagaaagtgcacccctatcccttctggaaccttccctattacaagtctctctaggcaggatcagcctgcttctcttgttctattactgacagtgagtctcagattccccatgggaacaagacaagggtgagggtgggaggtgtcaagggcagagtgctctgatggggaaaccaggtgcctgggggcatacaggccagcatgagaatccctgcttctctccttgctgttggctgtgacaagttcattacattttacttccttggactgcaataggctccctttaaaatgaggctgatagttcacagtgtgaagagttatgctaaggattaaacaagacattcaaaggtctggataaaggatctggcaccacaaaagtcaacaaatactagcatcattccttcagcttccctatttgtctatcacaaaccaaatcctttcaccccagttccccttgcttaaactcctctcctggcttcctggggtccttaaaataatgtccaggttccctagcctggtacacaaaacccctcatgactgggtccctgctcattccccagctccccacaagcctcacctgtcctacttgtcctggagtcaccctgggcagttggcatcctccaaagtgtgatgctccctcttctgcactctctatcccctcagcctgaagcaccctctcactcactcgacctggaatctcagaaggtgacttcagttggaaataggatatttgcagaggtaattagttaagatgaagtcatattggattaaagtgggccctaaatccaatgactggtatcctcataagaacaggagtggacacacagggaagaagctcacatgaagatgaagacagagatccaagtgatgcatctacaagccaaggaatgccgatggtcatcagcaaccatgagaaactggtagaaaggcatgggacagattctccctcagagcctccgggaggaggcttgctgacatcatgattttggacttctggcctcctgaaccatgaaagaataaatttctcatgttttaagccactcagtgtgcagtaatttaaatggaagccccaagaaactaaggcactgcccttgacctcttgatctcagcccattcagctgtctaagcttggagatcacttccccagggaacatctctgcattttcaggttgaggtgaggctttcatggctccagtcctctggctgttgttatccaatcatctgtttgaccattttcccattcaaggtcttgagttgccatttacctctaccatttatccagccttagttccagtgcttagcccagggaaggtgcttaataaacacatccagaagctgacaatcttcaccagactttccagaggaatgcaaatgcaagtacttgttttagctctgatcccagcatcaacaaggcacctgaccaaacctcgtatgcccctttgctgcttttactttctccaatgccagtgccttcagctggttttcttacgtacacaacctcaaaaacagaaaaatacacagagagataaaaagtataaagcacttcaaaccaccccaccaagagagccttctgaaaagtcaaactcagtacactgtttggcctggcctcattttaatctatttttcatgttaaaatatcaaggcatgaaagaaggaagcagagaaaggaaagaaagggataatatgaaaaatgctttatttgacaatgtgtcattcagaaactgattatttctgtctctggcctttttaatattccctcactatggccaagccaccaggggatttggtattctaagactggatttataatactctgttctgcagtgataagaacacaggcctttaatcctcagagctgtgaacatgcatattctctcaagtaatgtccttctcttctcgtcacttgtttctggtccctggcagccacgatgccatgatggctgagaactggtgatccactgggccttctcttggccacttgcctaatgacagatctagtggggaagggggcccgggatccaagtgatccgagacgtctcctttcaggccccagtctatgtttaagctggaagaattattagaaaatagtctaagtctttagtgttagaagaaaaaaaaaaaagaaaaagaaactgagactcaaagaatgaaagtgacttgaccaacatcacaaaccatcctaaaatagttctggagacagaatatgcagccgactccctccaaagctgctaaggaaacgtgaattgtgacaatttgatctacaaaatagcttctataactttccatttctctctactctatgactgtcctatgccctagttttcatggattttcatcatgataattttaatacatgctgaatgatcttccaggctttattcctcctttcccactatgctcaatccatcttacttaccgtaactaaggcacacatggaaactgatcccttccccattgactaagctaagaatcctgtagtttgacagttcaagtcctcatcatctatctttgtggataaccttgtctcgaacgtatgcttttgaaatgcccttcttcaaatgtgtgctttggccgtccatgcaaccacccctactaagctcttgctacagagaaggcatggtgccaagtatccaaccacagtgaaactctctgctcccagtaagctggggagcagagactggggcctgaaaggagacttgtcagagtacgtggagcctgagcctcctttcccactagctctgtcattaagtgagtggcgaagagaaggcccagtggatcaccagttctcaccatgatggcactgtggctgccagggaccaaactctcagtcctgaggtgtttttgtagaagccatttactttacctggaatgatgccctcattcttattcctcacccttatgtctacacatccaaataccacccatacttcactgttaacttcaatgcatctactttatgaactcctaggcttttcccttccccaggtgcagccagaaggaatttctttatcctctgcactcccacagcgcttcgccttaaccctcacttaaggatcttcagcatttcctaccttgtattagagttgttgatgctctttacttagctgccctacaggttagattattatgcccagtgtacagatgaaaaaaaaaaggagactcagaagagaaactgcttaaaaccatacaaccaagtagaaaacatatatgataagattttccactgggggcaattcccaataaaccatgggttcactatctcagaagggagcagctggagaataagataataagaaagttcagaacatattgcaaaaggcataaggatctaaagacttttagacactgaggatctaaaatttttttatgccgtagggtggcaaaatcagctgtataccttggaaagatcatagtgggcatgatggggagattgaaaacagggataccattgaggtagattttaacaagggtctaggatggcagttctcaactggtggcaattttgccccccaagaggcatttggtaatagagacatttttggttgtcacaacttaggggagagagtactggcatctagtgggcagaagccagggaatctgtaaacatctcgcatacacaggacagccacatacaacaaagaattaactggtcccaaatgtcaatagcgcagagtttgagagtccctagtctaagagagatgatgagaccagaactaagagagttaaagtggtgggtcagctaacaggataggaagacttgtgtctattggtggggaagggggtgtcaacaatgacactgaggtctcgattctgtcactggattagggagggacctatctatctacgtcttattttttcttgggtaatcttccagaaagttatacaagataccagcatgtaatcaaatgaagagatacatttacatgtgtgaacaataagggaagaaaaaggcacaacaaataagaatttgcatgtatacatgtatgtgattatgtatgtattcacatttgtaaaaatatactcacacctatgttaatacatctatagttagctatatttatctatatttcttttttgcctctagacagatatacggtgacctatttaagaagtcccattatataaaaagaaacatgtttctctttaaaataaatcatctacttaccatgtatctattagagatactattttacttccaaagataatgccaaaggagtaaagtaaaaacacattggttctttggaatgcattcaccttccacccactaccccccagctcaatcttccttaatcatctttagatcagattagaacagggtcaaaatcctgggagaacatactgaattctataaaaatttatcaaggagaaagctaaggaatgcttggagacaccagcgttttcccgtaagttagacagacataggttcgtctattgacatttttgttagtacagtcatgactcaaatctatgtctgtttgacttatatggctttggataagtcacttgagtttcttcagttctctcatctgtgaattgggttactaacacctaagtgggagaatctgtggaggattaaatgcgattgcagtgtataacacagttagctaatagcttgcaagtagtggatctttattattgatgtaagaccttgtttcctaaaaaaaaatttgatacaaagtagtggtgaaaccactacttcccctccactatacaatcagatattctctatacagtttcccagctgcattcctcccataggctccaagcggtgattgtgatcccttcccctctttggggtaagtaggtgggattggatggtttctgacagccatcccagctctaatattctagaaaattaaaaaagcaaaggcaaactggaaagcgttttggaagagatgaaatacatacattcttatgacatcttgcctggtattacaggtgtaaatgcatacattaaaacagttaaccacgctgtatccttcacaccatttcacgtttctgtgcttttgctcatgctccctctatctgaaatacccttccctcacttctttgtcgagtcctttaagcctcagcttgtgggtcatgagttctctgaaacctgctttttctgactgggttaagtaccacctgttaggtcttgcagtgactcatgcttttgtctgccagagcatgccgcagattgcatcatagtttgaccccctcccatcaccctagtgcccattgagggtgttcttaatcatctctgttttcccaggatccagctcagggtctgacactgagtagccctcattatgtatttattgtatttctacactgagaggcaatgaaaggaagggcagggttttatttatttctggttgaatttgaatggtacacagcacagagtagtagatcttcaattacttgttgaaagaaaggacgaataaatccatcataaatgcctctctaagggcaggtgaccaaaatacacctacatctgtctggcagtcctccatctgtctgtaagagagggctgaaggtaattcgcatgagccatttaacacaagtcagcatcccactacatgtcctcaggtggcctctcaagttctgtcgcaaatcccactctgaaggacgggtgaatggagaaggtaggggaaaacatctttaggaggattgagtttcttcccactctttgagtcatgaaaatatacagatgggccaggcacggtggctcacgcctgtaatcccagcactttgggaggccgaggcgggtgggtcatgaggttaggagttcaagaccagcctggccaagctgtatgtatatatatatatatatatatatatatatatatatatatacagatgaacccaagtggccagagaggagctttgccctcattcattgatttacttattccccagggtaaggtcatacctggaagcaggcagacctaagttcccatttttactctgccacctaccagtaatgggaccttgggacattctctctgtgatgctcagttttcacagctctaatacaggaataatgccattcaccaaaaaggctgttgtgaagatcggataaggtgatatgtataaaatatgtcacacagcccttgacctgcataaaacattcaatacgtggtagtcattggcttaactcttactactattattgtaattttctgaccctgtagcaaaccttctgcctcgatttagaaatacacaggtatgcccttgaagaactcacagttggtttgtggcaacaggtaagtaagcaggcagttatcacaatgcatagttcagcaagctccatgtaagagggaaacatggtaaggggcaaagagtttctcacagcttccaagtgtaaaacgtagagaaagtgaggataaaaaagatttttcttgcaattccaattacagtcaagttcaaaggtgtgaagaacatgcccatccaatcaagtacactcttgcccaaaatgtgacagaagactggataatcagctaaactgtgtagtggttaatggtgcaggctctggagttgatggccttgggtttgagtacctgtgctgtcatttaccagctatggaaccttggataggctactaaatttctctgatcctcatctttctcatcttaatgagactaacatttcatcactgaaatagactattgtgaaaattaaacaagtgaatgcaaaaaggaatccaacagtgtctagaatacagtcaatgctcaacaaaagatgatttaaaaaattctggcagaggaaaaacatattgagaaagaaaccaggcaacttaaatcccagtccttaccttacccccttataaagtaaaagaagtttgcagaaagctcacaggtcctcataaagcgggtttgtttgtttgtttgtttgtttttttaacagggtggccatagcaagcaaatgaactaggcatttctaacttcattaacagatgacaaaagtgagcctttcaagaggggttttgcccttcaaggctgaaaagtcagtgacaggacacacatttggctccagaatcctgtttgtctgctgcatgctgctacaatcatcttgaaatgttcggtgtgtctggagagtcggcagaatgaagagccttcatcctttgctcagtacattattccctgggaatgtgttgcagattcacagggctgatgtgagatccctaatattgtgccaaccttaaaatactgtgccaacaacaaagccttctgaggtcagaagtagggaaaagagaggaaggtggaggccagtgagagcctggtcaacactaatacatgaaaaataagtttcatatggggagggagcttctgaagggagctggcagcatagtgggtctgatgctggcttctttagaaatcatgggtgggggttaggggagttggtgtgggtgagggtcatggtcagggattgctgatctatcaccaagacagagtcacgttggtgaaggcttccctttgcacctgctctaccacagtgctcttcacctttgtctccatcaccagatctctatttcctttccttgctttaactttatgtcacttatctctcacttttattatattacacactaatttgttaactttgttcatggccttaatagaatggagcttccataatgtagggccttttgttttgttcattactgtcttcagcaccaagaacagcacttagtgttttgtcaatgcttagtaattctttttggagtgtatgaatagattaatggatgcagggatgggtggatggatggatggatgaatggattactggatggatgaatacatgagtaaatagatagatgtctctcagaatggtttagtagctcctcaaggacaataactagatatgaattatttattagcctatacccgaggaccgaaaaggctggaagatatgtagtgaataaagaaaacattgctgttagttcccttttggtgcccaggtaaggggtactgggtatagggataatgaagacacaaatgtgataactaactgttaactcctctctctctactgttggaccaaagaggaagaggtggtctgaattccaagcttgtttagtcatttatttatttataaatacttagggagatactgagccagaaagtaaaggggtgaaagggatgtcagatgcaactcttcaagcacaatcactttacacagaaagcaacctgatagctgtatctatttgttattactattactatatctagatggaaatcataggactttagtgaaagagggtgtcaataatgtggctcaaaaaacactggatttgggttcaaattctgactgggtgattagatgtacattccttggctagccatgttacctttttcagcctcagtttccccaggtttaaaatgatcaacaataacaggtgccttttcctctttatgtaaggacttcattgataatcatgtttttaaaagaactatatatgttatagagtaatttacacccatcagaactttgtatataggtgtttgttaaagagagggactccaaaaaccacaggtaactcaagcagagtaacttaggcgcaaaagaaacaaagctgcaaatctgccagctttccaatacttctgatacttctgtcatctatccatcaacctttttcaaaacctattacaagtcacacaataggggtctcttagaggcattgttttgctgccattttacagcattgatgctgtagctgccaattgtcttgacggcatgttgtgatggtctcaggatctcccctaccgggctagatcaagaaaacccctggaaagttagttactaggggcagagagtcaagcataagatgcccatcaatgagaagggaaaagagagaggagtcaatgggaggtgctctgtggcatgataggaacaggaattaaaagctggccagtgtccttgatgtacccaccagggctgagctggtatgattcattctttctcttcaccttgctgccctttgtctcctgagtatttaaagacgtggagttcaggccagtcttggtggctcatgcctgtaatcccagcactttaggaggccgaggcgggtggatcacctgaggtcaggagttcaagaccagcctggccaacatggcaaaaccccatctctactaaaaatacaaaaattagccaggcatggtggcacgtgcctatattaggggggctgaggcaggaggatccttgaacctgggaggcggaggttaaagtgagctgagatggtgccactgcactccagcctgggcaacagagtgagactccatttcaaaaaacaaaacaaaacaaaacaaacaaaaaaaaccatgaagttcaatatctcctgagtaatccaggtagtagagataattgcccagctacctgtcaccttacccttaacaactcctctcatccctgagataatttccacccctgctggcaggacaggcaacccagggcccaggctgcaggggaatctggtagaccatgctttctttcctggttcagagaacatctcagttgtaacactgataacgctccccgcccccaagccctaccatgagtgctgaacctcgatctgttccctgagatcttgctgtcacacacaggactgccccaaggtggatctccaagtcctgctccccacattccctcgggttgtacatctattgccttccaagacccaccctcatatccagctccagctgggctacccaagactgggcagtctccttaactgaatcccagggtaaaatacaggaactcaaagctccagcatattgtatccttaagtggtcagcgatagcgtccccaaactgccacccaacaggacagcatttgaagcactcattgagcctgagattggaaagatgaggtctggaagagcctgggaactgtctaaacttcagattaattagatgaagatgaacttaattccacagctactgaaataaatgttcatgtcacacagccgtctccaacccatatcggtgaggggtctgggctcactcaagaacaactagcctgggttcctggcccattcagagtcctgtgtgttttgaaccaaccagcaggtcctgaggaaatggactgaggtggaatagggactggtggtattgggaccacttcagagaaagtctttatttctggccaggtgtggtggctcaggcctatactcccagcatgttgcgaggctgaagtgggagaatttcatgaagccaggagattgaaactgcaattcatgagaatttcacgagggtaggagattgagaaacatagtgaaaccccatctctacaaaaaataaaaataaaaaaaggcatggtagcgcacatctagccccagctactcaggaggctgaggcaggtctgcttgagcccaggagtttgaggtaagactctatcttaaaaaaaaaaaaaagccctattgatcctgagcctctgtggaatctgggtgtgtgaatttcttcaggctgaaaaaaaaaaaatcacccaaactgagtggcttaaagtgttagatatttatctctcttagttcaggaggccagaagtctgaaatgaaggtacaagcagggccaagctccctccaaaggctctacaggagactcctcccttgcctcttctcacttctggtggctcctggaattaacctgtggcagcatcattccaatctgtctccatcttcaaatcaccttcttctcccctgtgtctctctccatctcctcttcttcttacaacaataccactcattggatttagggcccaccctaagtcagggatgatttcatcgtaagatccttaattaattacatctataaataccttatttccaaagaagattatattctggggttctgggtagacatcaattatgtcaggacactattaaaccccgtacactgaggaaggatatctaggtccattatttagttgcaagagtcactgaagcaacccatagtaagtgaaccaaagagattgagccaggaaagaaaaggtctaagagagaatgaaaataagacctcttttctcattcctcagtggctattctggggcagagggagcggacagtgcatgcatcatggaaaggtagcatcatcagcaatgacgaaagattccacagagaaggctgtggactgaaaacaatacaaaatatacaataaatcctttctgacacagtaaactccactcgccttttaagacagagcttgtgtatcttcttgaccctcccagatagagttgatcatccccaaacttgcctggtcataaataacacctggggatgctcattaaaaatacatatttctggcctttaaataagcctgcaggagaccttatcatcaggtagggttggtctgggagcagaagagtatttaaatcctatctacagcactctctgagtttctgatcacagcaggtcaattgattcagtatatctcatcttccttgtctgtgaagtgatgttagcagtagtatctactttaggattacatgcatcactctgctgagtgatgaaaaccatagaaattcttagtaatagagagccaggactattgccaagattacagctgtctacaatggccctaggccactctttggcatatatttgcctacatacctgccatccctgactagtccttcttatttgtgtatgccaatgtagcttcttggttaaagctcagactctcgatccatgaaatttgagttcaaatcttattgctactctattggttttgtggcttcttacaagttactttattctgtatctagaaaatggggataagcaaatctatctgatataattgtaaaaataaaacaaaataatcgatacattggtttgaattgatttaaaatccaaaacagaagtggaatttgtggaatttggggaggataaagggggaaggagcttgttgtcactggtgaagtccaagaagccaacggtttaaggagagtttggaaaggggagaatagaggcagagagagtgggaagcgagtgaggaataaagggagcatggaaaggaggggagagtgtaaggtgagagaggatagaaggaagtgcaggagagtagaaagaagcttctttttcaagaatcccagtggtgttcaaatcccatttctcaggccattacaaacataagaatctcgtctattttgctcagaatcttcttccttgttctctgtcccgacctagaggctgctgacttgggctgtcagagggccactaagtgagcacaccttccttttctcatcattgcttttcagggccctgcactcggggaagcagcccagaaggggattagaagatctgtggagacagagctggagtaactgtcttcaccctgccacctccatggggctgtataacaaaattacaaaagccacccagggtaagtgctgctacaaaagtaacagcaaaaggtaactgtcaattacaaaagcatctaggagcctcattttactcatccgtttaatgggcatcatgagggtcccatgagtgtattgtcttgttttgaggattaagtgaagatgtgcatgtaaacactctggatagtattaggaaatgtttcttctttataccccaggttttgatcaagataaatttcccccaaatctctctcttgcccaacatcctttactcctccccactaaggtagactggatctggaatgaggctgtgagcttgcataactctttcccttcattgcttcttttgccgtaggaaccagctgccctccaaaagcagccttctgctctgccctgccaccccttctgttttgtgataacagattcccatgtgagagggtgccaggcactcagcacttaccctgggtgggaaaatacccatttttgccaagtcctccaaactaaccttttgcagtaataaaggcaaaacattaatctccatctgctttactccttttactaatctttcaaactgttctcaattcaagtggagaaaatatggggcttccacaaatcccatgccgattacctgggtccaaagaatgttctcagcaaattgttctgttattattacattcaccagaaactctattgtctcttctccctttgttgggagcaattttttttctttttttaatttatctctctaaaagctttcacattttcccccttttatccatacagttctgaaatttcactgcaatgcaactaggtacagatttttttttttttcctttttgttcctcattcatcatgtttggtaatcagaggacactttcaatctgttgttccttccttctgctcagggatgagttctggcattatctacttccttccctggctctgcctggattctggagctcctctctttgctgttaacaagcaagtcttctaggaggtgagctggagcttgcgttcttccagtttcaatctcacagcctccctgcatccagggctctgtgtccttctgaggggcagagagcaggctgagaataaaactcctgaagaaatcagggaggggctgcaactgggaggaggccctgcttccaattcccccaagcgagcatgtgttcctcgctccaaagcaggaaatcaaacaaaattgctggacctaaaccagtaccaggctcagtggaagccaggaactggcaacttaatcctgttaatgagattttgggcaagtcgctcaatacccccttagcctgattttcctcatcagtcaagtggcaacaatcatttaccttccctgactcccagggtggttgggagaatcaatgaaatgatgcacatgaaaaagctttgcaaattactaagggctatctatgtataagcatatgtgtgtgtgtgcatccaaacatacacaacctaaacataccccaaaatgaacatcaaattacagagaaagactgaagtctgttaagcaaatttctgctcatcttttatgatccagttgaaatgtccctgcttctatttatttgactcagtgcctaaaataattagcttgaatttttttttaaaaaaaagaatatagtcaaacaaaggaattgcacttatggcagagtggtgatcactgaacagtgagcaatgagactgaccaaggaagaaagcagttttgtgttttctatcccatcttcactgtggattatcaatgctcattgagtgtaacagtggtcataataacctaaccgcctaaatttctgtttctgtgtctcttgtctctcataaaaaatatataggttaattcatgcaaataaaatgcacatttgataggactctactcttacaaaatgcttcatgtatctgtcctatgaactggagtttctcataagattctatttagaccaatgactccctgctaaaattgttgatggactatgtctctcagcaacaggagggtgactttggagtgtgttgtatccaaaagctgagcagcagaaagggggagttagatgagatggtatggactatgtaagtgctcagagggcaagagggtagagacaactcctctcctcccacagaccagcaaaggcagcagtggtactcagctgtctgccaccagcctgaaaagggagcctcaggcagggacagattgtgtttgggttggagggtaagagtaataactcagcagagacaatacagacgtgcttggcatattcggaccaccttaccaagatctcccctcccatttctcctccacgcctctccagcgccagctaatccctcctgaaccggccatgtgtctcctaccgtgctgaacagatgctcaacagcagctagaaggaaacccagtggaggcaaacacactcatctttctaaactaaaatcccactttccaaatatcagaacggacaggaactcagagatcttaaggttagctgacattgttaggattatcactgcttttgtacactttcctttgaaaaattttaattggaaattcatttctgaataaagccataaaagaggcgctgctccagtctaaatggaggttgggggtctgaaatctctagagctccgtggagcagagctagaaaaaaggactctttcattctgcacaagggaatgtcaaggctgagagaggatgagagccttttctaggtcaggcacgattagtggcagagccaggactagaacctggccccttggtggccatttcaaggtgtgtttccattgtcagactcaagacagaaagctgtttaaaggtgatccatatatcagcgatttcaagggttttaggtaagcaatcggtgtctgctgttttagtgtatttaaagaaggataaggctgggcgcagtggctcacgcctgtaatcccagcactttgggaggctgaggcaggtggatcacctgaggtcaggagttcgagaccagcctggccaacatggtgaaaccctgactctaccagaaataaaaaaattagctgagcatggtgacaggcacctgtaatctcagctactcagaaggctgaggcaggagaattgctggaacccaggaggcggaggttacagtaagctgagatcacaccatcgcactccagcccaggccaataacagcaagactctgtctcaattaaaaaaaaaaaaaggcggggggaggataaaattttattttccaagcccctattgcatgtcatttattggtattgacaaattgaatgcattattaaaacaaatcaatcctcattggaaatctgtgaggtcagtgttaacatacccattttgcagataagaaaacaaaaaggttaaacaatttgctccgggtcacgaaattaatctgtagcagccctattattagaacccagacctctaagactcagaaaatcatcctgctctccagaaaaaatgtcctctcatctgaaagtgtattactgtaactacaagcaaacaatgtaaaataaactactactacaacaaaatggcatttgcacagtccttaggtttaaaagcctttcccttcattagtacctcatttgagcagctctgtatcacatggctgggtctaggatgaggcaagtgggtacttgtcttgtatgcaaaatttaaaggggttcaaaaacctcagtaatgaagataatatttcaatgcaactcttttttttttaaatacaagttaatgcattcctgagtttataggcaaccctttaaattctacgtccaaggtgagtgaggcactcatattctttgctggtcctagccctacagtttgcagacctgtgaaacagggagaaaacatattttcataccaattgtgcagatgaggaaagtgaatctcagatacattaaataacattttcagagaactaaaggcaggtctttctgacttgagctcagaggcctggagttcatcttaatccaaatccagctgtggctctctcaaccctgggaatctggtgacataggtatgttggggtagggaatagagctaagtagcattatactcaccagaaaactgaggcacattcaccaaatgagttatccaagacccatggctactgtgcaacagagctcggaaataaactcggatggaactccacactcaatactgccttccatcattaccaaaacacgaggactaaaatgttcttgaataatacacaaaaattctgaggtgctgcatgaatccacagtcagccacagtcctggaacagtactaagtgggctctgtgattgctaccatcatggggaggtcccaaaggcttcatccctgggccagagggagtgagatggagagaagctggcagtagatgggcattggaaaaaatgccacactatagattggttggaaacttgttcaaaaaaaatgtgataagcaatgaagagggagctcagggtgggatgtaggaccccaggggctggcagtgacatgtgattctccttctgtgctggactgtagggtccatgagggtagcggtgtttctgctctcaagcgcctgaaatagtgtcagtctcatactaattgctcagtaatgaatggatggatggatagatggatggacagaacactttaagttcaatagagcatggtgagccccatttcctaaatctgactcccagctctaccattgatcccatgcaaagggtatcctctctctgctttagttttctcacctataaaatgaacacaataattctatgtaattcatagggatgttgtaaaagtaaggtaatatatgtcaagtcctagttatagcgtctaacacctagtaaatgctacataaatattagctatgatccgtaaagcaacagtaaagggagttatcccagaaatgcaaaaaatatagggatagttgttattttgtgttgtgtacctgacattagtccaggtccaattgccagtctcagattataaaatgtggaacaatgccaggatcacagagtgggtgagactaccattcttttggcattttctatctgccagcccctgccctacccacttagagtatattattttacttaatccttaagacatgcttctgaaatattaggttggagcaaaagtaattgtgattttgccattacgttcaatgacaaaaaacgcaattacttttgcaccaacctaatagtttctattattatctatttttttttataggtaaggacactgagtctcagaaatattagaatatttggtcaaggttgttggaagcaggtctgagttcttgccctccggcccagggatgaagcctttgggacctccccatggtggtagcaatcacagagcccagttagtactgttccaggactgtggctgactgtggattcatgcagcaccttagaatttttgtgtattattcaagaacccaacaactctggaggctgagttcttcttttgagacagagttttgctcagttgcccagcctggagtgcaatggtgtgatctcagctcactgtaacctccacctcccaggttcaagcaattctcttgcctcagcctcccgagtagctgggactacaggtgcatgccatcacgccccgctaattttttctatttttagtagagacaggatttcactgacttagccaggatggtctcgatctcctgaacttgtgatctgctcaccttggcctctcaaagtgctgggattacaggcatgagccaccacactcagccgaggttgagttctgcctgtgtgccatgtgtgccatgctcacagtgtttcacttcactctacctcccagtgggcccaggccccatctggaaagggaggagtcagagaggagatgctggtgctgggtgcttcctccctcctactcatagatggctgctgctctcaggctagctcaactccctggagacacacagttgtctttcccaaggaggctgacactggggctgccattggtcatagctgagggaaggtgacacaagtgatgctgcacagtgaaatccaccatctcatgtagctccaattgcaacctggctccctagaaggaggggagaggctgttttaataatgatacccctgctccttgtggcgggaaggaaggaagggcaaagacccacttgtggaggctcaggctttcctgagctctgtgcactggctctcctggctcccggggatttctttaggtcctttggtttagccatgggtgtctacagccacaggaaaagagtgggtcccctctgcactcaatggggatagtgagatgtcagggatataggtaaccgagacagaattcaaacccaggtcagctcaactccaggaggctaataagtgacgttggtcaagtccttgcccatttcaaagctttggttttcctatctacaaaggagaggattgtaccagatgatctccaagggtcctcccagtgctgaacctgttatgaatgtgtatactgataaatccaaggccaacagctctggctctggcccaggctatgggtgaatctcctccacaaagctcttctcagttggccctcctttcattgagcaccttcagtgatgagaaactgattattccttgatgatggagcaacctggggagaattttggatgtcactgactttcactgactagttgcttgacttcagagagtggactcttctctgattctcagtttaatcatcagagaaacatgaatgttggtgcctagctccagtgaccgctataaagattaagttggctagtaagtgtgtgtgaagtttctggcacccaataacaccccaacagtaattttctccaagttgcaaggtatcaccctgccaagtagaaataaacaagcaaaaatgggtggagggaaataatgctctgtttacatgcagatattaaaatatttccagtctttctcagctataagatattccaccacacccaaggatcagccaggcagcatgttcttctttgcagaactttagatgcattacttcatcaatgtaaaaactcaggcccagagagtttatctgccttgtccaaggtcacacagaaaatcagcagtggattcagattcctgaatcccaagcttgtcatttcttcatttggggaaccaagaggccctgccacccttggctgacagcatcatccccttagcaaaaggcagctctgagtccctgcaacaaatgtaagcagtgtctcctaagcatctccaaatgccaggcattgggctaggcacctgaagcacagaaatgaataagaagtggccccctcctccccagaggattacaagttggggagagacaacaggaggaggtggtaaaacctgtccacatgtttctataataggatcttcatcactccattattccccttctctctctataaaagcccagagaagcaggcagatgttggcaacatctgggccactgttgtcggggcagcaagtggctttgggctgccattggagaaaagaagctgttggtgttaagaataataataaagagctaacatttgcatggtgtttactcctgtttcaagggataacccccctccatcccatccccattcattagcccaagcaatgcagacagcagctctctgaaagcctaggagaaccatttccatttctttgaaggcaaagccaaggctcacagaagttaaacttcctgcttaaatcacagagctcataggagagtgcaggcccaaacataaaagccccatgactcctagattggtgttcattccatatgccaggctcaggcatgcaagtgaatgcaaaaagataggtggtcctttctctaaacataaagaaagcatttgctgtgtgtttactaggtaccaggaatggcattgtgtggttagtatgcttaactcctttaactcttccaacactatgagataagcattccagatgttccttgacctacaatgggtgttacatctgataaacccattttatgtcaaaaacatcataaattgaaaatgcattcattaccccaataaagccatcataaagttgaaaatttagaagtcaaccatagtaagtcaggggccatttgtagtttcatacttttttaaaataaatacagaagttgagattgagagagtttaagtaatctgtctatggtcacactggtgactaagatgggtcactggtaaagtgggtggttcagtgacgtggtgagaagagttgggataccatgttccttgtcctgtcttcctcataaatttgtgacactcttggtaagtggcaaagctgagatttgaatcccaaaaacctgtcaactttgggtgtgactgtgtgtgtgacagcggaagggaacgaggatggttgaaaaaggaggaactgagccttgaataggattcttccaggataaagaacaacagcacattgcaagctgaagcaatgctttcaatgggttacacttggcatgccaaacataaggttggtatgactggagcagagtaagaaaggggacaggagaaagacataagattagggaggtaccacaaagccagatagcagagaaccaagacaccagacggtgagaataattaagtgcgggtactataaattcagaacagacactggagctaccccatagataaaccttctaacagacctgcccttcagtcttcctctgtcttcagctatgtgggccagtttttctccttaatagggatctctgaaagtgtttcctgaggttttccaatcctcattttgtagatggagtctaaagcccaaagaatttgcccagactcacatagcatatggggggcttgacttaggacctaagccatgctttctgcagactctttttcacactccacaccttatgttctcggcactcattttctgcatattttgaaattttagcataaggctcacactctctcaatgactgtctgagtcctgaggtttacaatcctcctttccatctgagcctttctgggcttcctctttgtccatcgtagaagagccactcaagatgagagggagaaaaggacaattctctctatgccagctgctctttccaagcctaaggccattcaaagctagtgggaccattcgctctgacagtaactgagacaaataaacaaaactccactgaggtgaatctgtccttttgatgcttttcagagttgacacagtagctcctcggagtcggcatgactcatgagttctttctaatggattagtttgggttcatttttagctagaagaaaatttgacaactgcactcctgaaaaccaggagtaccttctaaaggatccatctggtttcattcaagttagaggtcattttgacatttatatcagtgcaagcagggagaatcttctgaagtaggaggcctaaacacaaagacctatagagcagcatttcccaacctttttggcaccaggcactggtttcgtggaagaaaatttttccatggacttatggggggcctgtggttacggaataaaactgttccacctcagatcatcaggcatgagttggattctcacagggagtgtgcaacctagatcccttgaatgtgcagttcacaataggattcgtggtcctatgagaatctaatgctgttgctgatctgacaggaggcagagctcaggcagaaatgctcattcgcccaccagtggctcaaatcatgtggttcctaacaggccacagactgtactggtccacagccctgggtttggggaccacttctgtaaagcacataaatggggacttgagtagggtatcatagcagacaagattagggagtggtagggactgtggcaaattagagaacatgtgatccttctaaagaagtatctgctactgaaattcagccaattgtcaccatccaaaaatgcagactgagtagaacgtgcaagttacccccccccacacacacacacaccacacacccctatattttcatatgaaatttgacagtgaaaactttctttggcaagtcttttttttttttttttttttttttttttttagctgagtggcccaattgcagacaaaatgagactcatctgtggcctagatatggacttgggctcccagtttacaacctctgtcctatggggtccaattagtttcatttaacgtggagcttactttgacattcacattactataaatcctcttagagagtgtttcctatttggaatggttcccctggacatagcctacatcctcccaagcattcctatacattgctgggctgaaaattggcaagtttccacctagaggctataacctataaatatatctcaaacctccattccttttacactctgctggtggatataattgagtttctccctgtaccaaatgagctctgagttcttagtacttgatgtacttaatagaggaaagtcgggacgagtctggaaaagcaaggataacacagaaacagaacagggatatgctggctggaagcatcctaatggttttatcatccactgttagaagagaaaagcataatagtataactatcacaccctctgcataataaatgccttatggcaccctggccagcacatatacatatgggtggccttggagacatcatggagggtttagccactgctaccagtctattctcaagaggaagcaagtgggcctaagcatgactggagatgatgtttggtagaaaaacctgctgttccagaggcatgataagaagacttccctaagggagtcccttgatacatattatgtggtccccactggtgtgtggaaccaatcaagtaccctgggagctgcccagagcaaaagtgtgttttggaatcccacagggaactccactctgtgtgtcaccctctgtgtggttctgcaggaaggacactaaactatagccttccagtttgcttgttgattcctgcattctttcatttattcattcattcaataaatattaagtaattaatcatcatcgccatcgtcatcatcatcatcaccataattgttgttgtaatttattaagagtcttccatttttcaggcactttgcatttgcatagataatttccttcaattctttttgcaagaaacatattgctattcttctttcctaataaggaaactgaggcttagcaaggtcatgtgatatggacaaagttgcatagctaagaagtggcagagctgaggagtgatactatgttgtctaactctcgctgtggttttctcactacaaaacactgtctaataattgtatagtactttgttgtgtctcagaaagtaattatttaattctcataactgagaacagactgaattagacttattttacagaagggaaactgagtatcaaacaggttaaccaacttgcctgaggccacccagcaattaagctggtctcaagcataggtcttctcactgcaagtacagaatcgtttaaaataggatataatattcatgtttacaattccttcagtgataatgacaaccattaataatcctggaagttattaattactgatgcctcactatgtaccggaagccctgctaagtgttttattggaattcactcacttaatcctcataactatcctacaaggtcagtgtgactactaccatcataacgtcacttggctcgaagaattaaatgaaggttgcccaagctaggcagctagaaaatagcagagcaggcattaatagcaggtttatctgatccttatttccaactaaaattcttaaccccgccacccctccccatgatgtacagggcaggccttgggaaggataataaagcacattcagacccagacactgtcagatacttcaaggtggctacccaatatgcatttccctttcttccttagtaccagcccatgcttagtacctaaccatgatatggttagtttttgtgtccccaccaaatcatatcttgaattgtaatccccctaatccccacatgtctagggagagacctggtaggatgtgaatcatgggggcagtgtcccccactcactatcatgagctgttctcatgatagtgagtgagttctcatgagatatgatggttttataagcatctgacagttcctccttcacacactcatgctctctctcacctgccaccatgtaagacgtgcctcttccactttggccatgattgcaagtttgctgatgcctccccagtcatgcagaattgtgagtcaattaaaattccctttttaaataaattaccctgttttgggtactttgttatagcagtgtgagaacagtctaatacagtacacctgtaactaacaactacatctcagtcaggtggctatattctggccactgagatgtacatatacatactaggagaaaagctccttaaaggcaactgcctcatctgggaggtgtgccttattatcgatttatttttctctcccttcctgttgtttgagtagtgaacatgataactgattttcctacaattatcttagaccatgtgagtctaaggatgatccacatggtcttatcttagaacagtggggaaggaaggaaggaaggtaggacagtggggaaggaaggaaggaagggagggagggagggagggagggagggagggaggagagggagggagggaagagagggagggatggaggaaggaagtagggaagggagtgagagatggatggatggaaggacagaaggaaggagagaaggagaaaggaaggagaaagggagggaaggagggagtgagggagggaaggagggagggagggagagagggaaggagggaaggagggatagagggaaggagagagggagggaggaaggaaagatggctggcttaggtccttgaagacactgtgaagctgctataccattccaagctctcctatcatcaacgtgagagaaaaataaatttcattttgtttaatgcacgattattttgacttttttcagttatatgtaggcagatctaatgtcaatgaatacagacctgccctcaagtagctcacagtcccgtagagaagatgaatatgcagcagacatatcatgatacaagtagaaggtggctaaagcattgaacaaaactaaaaaaaagagctcgattcatcctccgtggcctccacggtaatgaccctgacagcaaaatccacaggccagggcatgctctctgtgtaatggcaatggataagctgtctgttctgaaagacgaatgcatccatttcaattagatgtgcccagtgctacgattgtaaccaattaatcctgcccatctgaaggctgattagtcggaatatttgggtgaatggataataacaggctaataagcctgctatccaaatgctgccacacgtcttttttgacacaatattgtggatgcatttgcagcatctgtgactaatcttcaagtggcgggaggcccagtttgcaaagcggcacagggacagggctcagggctgctggagtctcagcagacagagcctactccatctagtcctcaattgtgtgtttggatccaggcacccagactcttcctctaatgacatccttctgcttcctgaaaggtggagacccacattgcaggcacggaggctgggtgcagggccaggaggcagaaggtctcagtttcaggtttcaggcacaccctgaatgcactgggtgattcaatcatgtctctttccctctatagttttttaatttcctcatttgtactactcaccataatcccgaaacagtcttacttctgccccctggtatctgctcaccatctccttgcctagtacattctttcccactactctttgcctagctaattccttcccattctttaggtctctgctctttaggtcctattctttaggtctctgctgccttctggaaaccttctccagccactctttgcctaggtctctgggctacatagaatcctgtgtttcatgtattttaatgaatattgcatgagtatttactagtccacttcccccattcaactccaagcttcatgatgacaaagaccacgtctacttgcttacaactatgtccctgatgcgtggcatagtgcatggcacagacaagacaaaataacatgttttctaaagccttgttctccccatttcactgaactaagaggcaaaaggaatctggaattgaaaacaaacaaaaaaaagccttgcaaacctctaaattgatacacaaatgtgaggaattaggagtaatgaaaaagtccttgaaggtacagaaagaagcaattcaattcttgcaagagattcacacttgctcaatgtgtcaccaataattactctagcttttccttccctcatttgttgtaattaagacatagtgttttcattaggggagaaaccaaggcctagagcaacagaaattatgcacagtgcaaatcctggcaccatggcaaactagttgtgtggacgaggagaagccatgcaactccgctgagtctcagtgtcctctctgtacaatggaatgaaaatctccactgcagagctcataggtggctgtgagaatcaaacagttaatgtgtataaaatgacttgtaatttgtaaaatgctgtaaaattgtccattcaataacttcctgctggcatctctcccaaaaagacagtggaactcggatttcccatccctaaattctggggaagaggacagaggttaaaggagagtatggggtgtctgatgcatttcttcacttaattcactaaatatttactgagcatctagggggtacaaggtgctgtgccagaaaataggaaacaagaggtaaataaagtgtgcccttatttcaaagtccttctagtctggaggttagggggtgaaatgggcaagcaggtgaaccagtaatcaccaaaggacagggtgtatctgcaaaactatgagctcctagaatggagggatggtggataccagccctggggtgattattcagacctgacccagaagcaacatctggaatagttgaaggtccatggattctatcttgtgagggattttgaacagaaaagcaactagtttcaatttaccagttgaaaaaagattctggaggcaggcaaggagccaaaagcactgaggagggagatcacggcaggcagctaagtggagtctatccagaattttgtagagaagaatggaaaaagaaaaatcataacagaacaagagagaaaagtaagagggactcaggaaagaatattaattgaaagtgtgaggaaagaatgtctaataagaaacttgtaaagataaagacaaaagaagccaggattagcggcttgcctccttaacttagggtcttttgaggctatctgctgccaataccatttgtcacccaggctgccctcctggcagtagaacagaaacctgtctaaagcagccccatcattgatgaagtccccaggaatgggagacagctcagacatggattctgattctgggagtggtgtgtccccactgagtagcctctctcatctgcagttccttcatttgtaataagagggcagcaacacccacttcacaggagcaagagtcttgagtatgggatgatttgtcccaaatacagtcctcgaataaaacttagtttctgctgtattgagaataaaattaaaaacaaaaacaaaaacaaaaactgtcatccagcaccagcagctccttcctcacagtggaggctgcaatgtggtgacaggcccacagcccacacctctaagaggttcatcctgagatctggctctgcttcccttctggaaagaaacaaaatgcttcatttctgaagatggaggagagggagaaggctgtgtcagctccttttcctagaggtgctgggcacctggcacatggcactggggtgcagcaggtgcttgcaagacatgactcatatatgtgcctgttagtagtgacaatccctttattggtatgaagcatggctcatgaagccctttaacacgctgtgtctcattagtacctctcagcgacccctgcacagtgatctttttattcttagcctccaacagacaatgaaaatgaggcccagaggtaatcaggtgtattcacagacactatggtgtgaaagtctatttaccgaacactgtcatgtgtcagtcaacgccccagcctctggcagaagaatgagatatagtctctgatctcaaaacatttcccatcctgtagagctatagacaggaggaagggtaccttgtctacatcaagtgaagtgttatggtggaaggaagcttcgaatggtgagtacacacttaggatgcttatgaaattcaaatagcaaggacaaaggccatagtggattcttggagaagctgaaatgtgagttgagtcaacagtagctacttgcttaagtggaatcgaataaaaagaggagtgacagctccagttagaggaaatagaatgaggaaagaccttccagtgaaaacatcatgaagtatcttccatgctacgcaaagttcacaatgtctagtgcatacaatataaggctgggagtggcagaattgcattgtttggatcctagagagacttacaagtgaggccatggagttaggtcaatccttaagggaatggaaaccatggtaactttccaaatgtgtgctcagtgactaggctggaaccgcaatactgttggacaatgacaagacaggtctatgtcagtggcacctttctagagacagaagcaaagtctgtagtttctgcacagtttgtgctatcatgtgtttgatcaaaaagcagaagggtggcatatagtgcaaaccccaaacaccccatctggaaaaggtaaaggacatgtaggagatggtgccaatcatctacttttaaatacaaggtcagaaactctcatgccctttgtgcaacacccagtgttgtgtttctcagacttcatcaaggctggatggactatcgggctgcctcactgctgatgatgaggttcggggcaagtctcttcactctccaggcctcaatttccacatatgtacaatgggatgattgagccagtggctctttgtgctcgcttctacctttggcatgtgacaagtcttgctttctaataaatttttcagtgagtatttaaaacacctgttctcctgagcaactcctgtaagtcacatttgcaagggaaggaaagaacatagctgtggcttgataacccataactgctgaagtcgtatgaagttcttcaagtagctacttggagagaagaagaaagaaaaacaaggcaataaaccctaatggaaaagaaggaaaagaaaaggatccacgggaaatctgttctccccagtcttaaatctcaaagtcacggtgaatgctggcagcatctctctgtcctttctgtttaatctcacatcttcctccctgcaacctgtcctctttccttcctcaattgagtacttaaaagtgaaggctttattttcactctgattctcctttcacagattgtgcaaactggaaaaccatttaagatcattttgcccagaggttttcaaactttattttgtagcagaaccctttgttcaaatgaaattttacactcaaaggccaacatataaaatttataaaaggaaagttcctctaagcatgacgatcgaaggccatgcatgtggttcctctcttcacccaccaccttccccctggtcttgaggcacccccacagatccctcaggtcccaaggagcatgacatgaaaaccactgacattgtcttttttttttttaactttaaagatggagaggctgaaatccagatttaagagggcacttattcaagccgtattactggaagtcaacagagttggagccagaattcaggtctctggggtcccagggtaacacctatgcccttatcctgttgccttctttgtcccaatctgttgagacctcagtctcaagggccttctaagtggcattctccccagaaaatgtcaccgcctactcatctcctctctccctttctttagaaactcactaaccgcccactctgagtgctagttctgctgtttggaagcacatgtatcagcttcacctgatgtggcagacatattctctaagcctggggcttttccattgcccactgcccccgcagggacttcttaatccaggtggaatcagaaggcttcttatgaatttcatttcatttcaacacacacacccacacacccacacccatagtctttagtgatgcagacataggaactggcagaaccagcaatgaatgtgctaggcatcagaagactgggtttgagtgctggtccaattcttttcaacctctttgatcctgttagacacatttctttgcccattgaggcccctgccctcctacttcacaagttagtgttgaagatcaaataagataatgaagacagaaggactgataacctataaagtagtttatacatgtaaggaatgattttctttggtaaatttctcatcatttcccttgggcaggataatttttatcagttaatccctaaaacctatttccaattatctgttaatttattaatggatagttttagaaaaatatttttctaaccattatttgatcttgccttctaccaaaaccattcatttattaattcattaattccataaacaccaatgaagcacctactattaggttggtacaaaagtaatcatggcttttgccatgactttaatggcaaaaaacagcaattacttttgcaccaacctaatatttgccaaaacactggctccattggtctcataaagtccaaggtctcatgagaaacacagatactgtcattcctgtggacagtgcttcaaatggggaaacacagactgagagaagcatatgggagtgtgtactctagcctggggtgaaaggtccccaagggcttctaggaggaagtaatatctctgctaatatctgaaggttgagttggagtgatctgatgaagtgggtgaggataagacaggaaaaccctgagtcacccagaagaagggaagagcaggtggaacaaggctgcaagtagttcagaagggctgaagcagggagggcgtggccacaggtgaggctgaatcaagaacaagaaggagtgggagcgcaaatggttctatgagtgaagctgaggagtcagcactatgacagcatcctcgctttgcagaggagaagctgagaaccacagagatgaagttacttgctcaaggtcacaaatggaaagcaacagagatggaaggtcaatcctcagctctgtccctctgcctggagccctctactcagatacctctgtggcttgttcacttccttataccattcataacttcaaacaaatgctattttttttttttaggtaatgctttgtgcgacaccctttaaaaaaatagaaccacctgtcattctctatcccattaccctacttcatttttgtctcatgatacttattataaatatggtaatttaatataatataaatttatctatttgtgctttgtcctcttctttgaaaaaaacataagcttcatgaggacaggaatttcattctattcatgttgtctacctggtgattataacagcactgagcacatggcaggaactcaataaacactaaatgaatatgtacctgaataaatgaatttcaacctatctaaagcccttgctatgatactcaagttatatttctgtgagtgatggggagtttctaatcttttagctgctattagcaggagaataacatgatagaatctggctttagaaagttcacactggtagcattgtgaatgatgaatcagagagaggcaaacctggaggccaggacagtgaaaggcatcagtactaattcttgccagggaagatgatagtgtaagattgtctacactaggtagtcataagagggatggagaagagagtcttctaaaaagcctgaagcctcaggcagactatcagcacaggaattgggagctcactaagagaagaggtcataaaaggaaaaacacatctccaaggaggcaaaactgttctcatttctaaatattatgcccaaaagtggctagaatagtctgtcaaattaaattccttcagaacaacctctgataaaattatattctctataggttggagaagaggtgtctttggaagacgataaaggagatttttgcattgcctaataatgatggggatgaatgtcttaatcaaatggagatcaaggccaggctcatttgataaagaggccagtttctctgagaagatagagcctgagcaccaagggacagtaggatgcccccgaaagtgaattcttcctccttgctttgtgcatatgcatgcttatctgtggccagaactctggaggcaaaactaaaaggtggtggtttctgttctgacaaagcctggacagaaactaagaagatgctgcaagtaactaatttgattgcatccattcatttccctcgttcattcatttaatcaaccagtccaccagggggtcttcagctaatacttgctgatattctcaaagtgccagacacgcactaccaccaaggacagagcaagaaacaggacagatccaggctctgtccacatggtgctaatggcccagtgtctcccaactatgttctttgcacaaggtcattaaattaaaaaaacaaatcgttatgttgttagagtgttttatatttgccagggactagatatgtcttgtactatttaatcagcaattctatgaggcagttatcatcaccctcatttgtcaaataaagaagctgaagctcagtgaggtttaggaatttgcagaatgatgcagcctgagatgtgggaacatgtatttaaacccacgtcaagattttgccaaagccctttttccattctctgcagcctcttacctttgcagaaattgggctccaaagtcagataaccttggagtgaatcctggcttcacaagaatgtgcacttcagatggtgcctggctctcagtaagtgctatactatgttatatgttgttgttgctgttattactaattaggcaagctcttcatctcagagtcatagcatcctctgtgaaatgggaccactaatgcattatggaattttgatgagaattatgaagatttaaatagatgatgtagattgtgtccattttcctgtctgatatattgggcagtcattggtggcaaggtcagagcccctggtcataccatgactgagaggcatgactgcatctctggaggcctggtcccaggagagatcccttgataaggcttttcttcctctccacacctgggtccatttgttcaaaggggctacagtgatctcccagatctgttcttatatctcttgtttctcttcagcatggggagtaaagcagaggagcaaaggaggtgctgggtcatgaggccaagaatagcaatgccctctggaatgccctgaggcaaacagagctccaggctagggaccaatcccagagacatttccttggccaccaccaaggctgtcttcctcctactggaaagcttccccaagataaaaaacgagctggtatggcaggaatccagcaactctagtggagctggacattgtgacaaaagcaagggagggacatccatttagtgaggactttctgtgccgggcctttgcctccttctttgcctgtccccaccattcttattctcatcacatctctaaaacaagcagggattacctgctccatttaagaacaaggaaatggaagccagagaattacagcagttgccggcagtcgctgtccctctgaccaggcaatatctgatggtgtcaaagcatccatgaaacaggagctggggcagaattgtggggaggatgggcctacgataacctcttgtcctagaatgaagctgaggtcagcctcaggactactggcctcggaaatgcagtagcctgagcagctcctatgccttatttcttccaccccattttggccacacacccagaggttcttatctgcatgaagtgccagcaccaggaagcctttctgagtctgaacgctcacaggcctgcctacctccccagccctgaacagcatcccgacaggctgggagagcttggaactctggagtctggcaggggaggtgaaggtgaaggttccaacgccagctttgcttttactgagatttacttccttgggcaaatgactccaactatgcgagcctcagatttttccatctgtcaaatggggccaataataggtaccatagaatgatggtatgagaaataaatgataagatgtattgaagcacatggtgagcattcactaaatgatggtcatagagtcaaaatgataaaggctatcatttattgaggatttactacctgccagacccagttctaaatgtttgtgtagtgattaatatccttaagtagcatttatcattattattgatacattttcttaaattcaacatacgtttcatctaccacacttctgtaaagactactacaacccaacccagggtttccttggcaatttgatttgaccaacagctcctgagcacctctgaagggtgagacccagggttagacaatggtgagacacaaatggggatcgtttatggtttctgctgtgggtaggaagcttagtgtcaacttaagcaataaaacaggggcacagttgactaccataacataaagcagtggcatttaaattatgtcccattggggcccacaataataaatacagacagttgtatatatgtgtatatatgtatgtaattaactaaaattttttcacatcaaaaaatactagatgtgagtcaaggtgttccattctggtttattctattttggtacattctgttccattccactctattccatatcactgtctattctgttcgattacacattttattctattcagtcctttctgttcctttccattccattctattttttatgccctcttctatttttcttaaaaaggcttgctgtgagccagtaaatatttcaggacttattaaattgtttcaacccatctttcaaaaagtactgatataaagaagctgttttccagttagttgcagcgaagaacatctaaattaaatcctacctaatcctagtatatgaaacacaaataatcacagttcttctggctgaagaggtgttgggggtccagaaccaactgtttggtgacttattccattctgggcatccagaaatcagtgaggactatttagagttgacattaattataaacagccccctctggacttccagagagagtgcttcagagaaaggatggaagggagatcatttaaatttgtaatgcattctgtatatttatcggatgcctactgtatgtcaggtcttgaactagggctgagatacggcagcaaacaagatgcatttcaccctcattaaggggatactgaatgcctaccatgtgctaaagcaccttacacacagaagcacttttaacccacactgttcccttgggagattatttgtgttacacccattttacagataaagaaacaggctcacaaatagcctaaggtcatacattgatgaatgttagagctgtgatgtaaacttgggttgattaaactgcaggttctttacttctaactgggacaatattcgaaaggctcagagaggaggtggtttctgagatgaatctacctgtagaggtgaaggagagtcttccccccatccctcaagaaacagaatggtgtgagaaaagtacagaaagaagattgaggatgaaacaaatgccgggagaacacggaggagacatatttggctggaacacagaatgtatgacaaagagaattgcaatggctattgcaagcgatgcagaacacagggaggggaggaggaagaaggctcagctctctctagagaagctttctagaagccaccggggcaagtaccacaatgaagggcatgttggacaggtctctgttggaaatggagcatcaacttcaatgtggaaaggtacaacttatggcaggaaaacttacttctttgaaagcacacatctagagataatcatctatccaagggaaaagcaaatttggtctgaatgaaaatgatgtccacaagaataaaatcctttcacttggatcactaacaaaacactgcctcgttttcaatgcatttgaggctcacaccaagcctgcaagtttggcagggcagagatgactgttttctctgtttgatgatgcggaatggggagtgggaaggagttgcagagctcaactcatgttcagcctcacccaggactcgccttataccctgtgcttcctcctcctatgctttccagagaacctgctcctcttttgttcagaggctgctgggaaagtagggtagcacatacactaaatgctggaatcctggggcatctgcagctggtgcagtcctcagaaatgccactctgagggtggacagagaataaagggacctagtgtttatcagattttactatatctcacacatattggataatgcttcctatcatggaacgttatcattggttaggcactaaggttcccatcttaaaggtaaagcaagtgaggcttagagagattaaaacagttgccaagatcatacaatcaatgactagaagaggctggacttgaacttaggtttgtttataagcccatgttcatttcaccatatcatgatgtcccttgatgtaagatcaaataatggaaaatctagactacgttatagtagcataaataagaatacggaaaagggaaagaagaagaaataaaggaggaaaaagagaaattattaccattctttatcccatgactactacaattcccctactactattataactcagaccctctcaccttctaaattagtttttcattcaacagcatatttgattctcacaagaatgctgcaaaggacagaggacccactattttctatgcatttaagagatggggaaactgaagttcagagaggttaagaaattgttaaagacacagatagtcagttaaaaacctggaataaaatttgatccaaaagatgtttagctggaaaaaaaaaaggagacagaagaagacttggaatatttgaaagcattctttgaaatatttttgtagcacaacttatagaaaaaaacctccacatttttctatgggactcagtgcacatacacacaaagatacacaagcatcaaacgtttcagaaacaaacttgtccttactttctctattttgttctattctatttccatttgattttgatgaagaaaatgctggtcctgattcattaaatggatttactatcttactaatgggtctaaaaggactagagtttggggaacagggacacactgacttcggggctgcatgaaagctagcttaaaggatccaaagaactccaacatggaaggaaaagtagattcatgatccagcgctagagatgacacaactatgaccaaagagtagaaactgtgaacacagattttaggtcaatctggagaggtctttctaaataggcaaatctgttcaaaaatagaaagattgccctgtgaagtggtgagctccctggcactagagccatgcaagctgaagcttaaagatctcttgacagggctgctgtagaagaaattgaaggtgacctctaggtttctttctaggccagaaacattatttaatgtatttttctcattttctccccaggacagcagccaccacagaaaattttggctttgaagtgagaatcagaggacacagaggaaaaatagagatgctgaatgttggttccactgtcaagctggggaaatgatatatacctctctccattcccacaacataggagaaatgaggggcaaaacagcattccaggagtggactaaatgtataaaagaagagcaaaggaaatcggagaaaagaagagatttgttgtagtcattgctctgccctcttttccattgtgggacaaagggccagcctcagttttcccacctatacagtggggatactgttggactacatctgcaaggatgatttcagttttcaggttataggtttttttgttgttgttttattcctgggtccccttgtcactgctcaagatgccagcttggcagctgaggccagtaaaaagaagagtagggagtggtttagtctctccattggaaggaagaaggaaggaacgattgtggcccatctctatagccttgtgctgacttagagtgtctcatcccatcaaacgcatgggtcatgaagttcaattcattaattttggtggtggagggaggctgacagacttggtgctgacatgaataatgatgggtcaccgggagaggccccagcaaaacctgcagcttaatcagactcagagagtctctgcgggcattaatgtaggccaagtgctttccagccaatcagaccccatttcaatttaatgttgcaaattgttaccacgcagctcagcctctcaacgcacaactcagactcaaaagtgggttactcatctgttcccttttcctgttcatttggaaacacctccctgattattgtctgtgtgacagtttgcagcaaaggaggtggataaagtatggtggcaagaattcacaccgggttatgtaaggggagcgggtgtccctgctccatcactttctattcacatttctaaagccatgctttgcttgcttgtaaaggtctgctgtgtctccatcgcctgcaggataaaatccaagcctttatcatcaaaattctttagccttaccacccacagtgcttccccaggcattctctgccacagccacaacaaaccacttccactccctaaaacatgctgtgcccttgcatcttgaagcctccttgtgcttgcatatgttgtgccctctgtctgaaacgtctgccttagctcccctctgttttctctgcctcacctgtattttccagtgtcaccccagaaaaagacacaccaaagtagtagatcctgaagggatagggatcgtctatttcacttcttgcctagagtagatatacaaaggtagaataaatgaatgaaagaatcagtatataactttggccaagacatttcaagtttctgactcttctttttcttagatacaaaataataaaaatagctctttcacagatattattgtggccagtgacggaaggcttttcagcccttccaccctcccagtacctctgagagccttctttggatgaaattgtccatgtaagctcctgacctcaaaaatgctccccttagctcctggggcttcacctctctgtagctcaggtttctcagatgcaaaatgtgtgtactgaagcatgaatggttggaaagattaaaagcatgtattcactcatccctgctttcagtatatacaaccaatgtataagccaaaaataaaattctaaggcccccctcaaccatctgaatggacccctcctctcggccaagggcatttcaaagttaacctgaaaaactagttcaggccatgatgggaaggggaggtcagacatacctcattatgccctcctccctttgggaatttgggaaaaaccaaccagcattaacatcagcacagaccatagatctaataagaaacgtatacaatctgttttctctgaagcctgctacctagaggcttcatctgcattataaaaccttggtcatcataacccagacattcttttctattaataataactctttcaaccaattgccaatcagaacattttaaaatctacctatggcctagaagtccctgctttgagttgttctgcccttccagatcaaaccaatgtacatcttacatgtattgattgatgtattatgtctccctaaaatgtataaaagcaaactgtaccctgaccacttcggacacctgttgttaggaacccctgaggctgtgtcacaggcatgtccttaacctaggcaaaataaagattctaaattgattgagacctgtctcaagtactttgaggttcacagatgcaaattattaaaatgatgactgtgaaagtgactttaacagaataaggtacagagtaaatgctcaataaaagctttctacctctttaaaaatctcatatccttttttacttcctgtccttctttcttcttgctttcctttcttttatcccttactggccctgtcatctccctttttccccaaggtgtgattttggaattctcatgggcttggggagaggggatcaggtacagcctaacgttgcccctaaaaaccctgacacaacatcaaagctagccacccctttaacagagcacatgaatgcaatgcactaagaccacaatggcttcaccttcaccaactgctatatatactggactttgagttcctttgagcaatctgtcatgtgaacagagggcaaaagggttattattaattaagggaactgggaaccactgttattcttcttctaaaggtctaccatcaaaagtacatctcaccgttccactctatcctggataaataagtgccaagattgaggcaaggtctgaagcaatgtggtttcagttcccgtcctcacttcctggtaacaaacttcatgtgctttagtgcatacataaatcccctaaaacttatcaaaaaccatatacaatcaagaatcgacaacctaccagctgtcaacaacagcaatggtgttgagaaaaatcaaaaggtcagaaattgtgatttctttatgtggtctttgaatgtagtcaccaagatgggaaagctgaaaggtccagatagttatactgtgtagggagtggtaagggagaagtcacatctccttactattaactaactgtgtgacctggagccatctatttctctctgaactttagctttctctgttgtggaatgagtctggttcagtttaacaaaacccaataggcacataccatgtacctcccaggcatgaagctaggcacagacacattgacaaataatatatagcttaaattgacggggaagactgaatttgaaagtactccatacaactgaaaagtatgctacacaaatactccataactcttttgtgaaagtgtgtataagtatgtatctgtttatgtaaacatgaattattccagtgaataaattgtaaagtgaagacattatgctcagtacatgtatctgatataaattaatcaatagtcttgcatgaatgagatgttattagaataacactaaagacagagcagtgagcacaatgaattccctgctttcatgaagatcacatggtagtaataagaaagtcacatttgaggggatgaaagacaacagaagatccctgggcattttcactcagttttggcagcataattagtgggaaacctttgtttacaaatagagactaggcaagttgagggtgtgtaattcagcagaaattgggccaagaagtaggatgaccatgtgctgattcaggacctgacagcaccatgcctagtaaatgctttaggtgttgcataggcagcagatctgttcaatctgacctggatttaaataagtttacacagcttcaaagcacttggaacgtctgattccactttcatggctatgcttgaattcaccaggtgttatctctatcagcaaatgtttcttcaataaatgcccagccaagcctcctgcttgaacactgaagtctgaaacaaaagaatgttgaactccaaagtctgaaaaaaattaatatcacaccatttctcttaaaatgtctcccatgactctctcctcattcttacctctgctttctatctcctccaccatctgtagccctaaactgtgcatttgactggaaatgtatcactcaaggcacctgtggtggagtgaaattggttaggatttcatggtcccatccaatttcagctagcagcaggcaaggaggggaaatattcagttatgagcagtctcataccttttgcttttctcaaagcaaagtttgggaagaaggatcttttactgttgttgtttccactagagaactttgtccctttggaattattttgccaaagactgtgatagaatctattaagaagcatctttaaaactatacttattgggcaaggaagataatactctttattttaaaaaggtattatttcaattctctttctttctttttatcagcattatcctaatggcctctatcatttaggaatcagagaacgacataaacaaaagagtaaatctgagcctagtaatttccaggacttcacccaggaatagaggataaaatttataccattagcagggatcatcaattttttttggtggtaccagagtgtgggtatacgggagaaaggaggaggccacaccattaccatcacatgatcaagactgcaatttgtttttcctgtggttaggcagagccataagatacggtactcaaatgtaaggatatggaaaaacactttgtggttattaatttcatctcctacctaatactgaatattcccacccaacactgtggttgatattctgtttctttttttatttatttatttatttattttttatctccttagcatcctttccctcttcatttttaataaagacctagttttcctttgagaaactaaatgataccccttcaacaccctcaatccatgtagtctagatctggctggcctgagtctcagttcaggagtggccacctaacccagagttggccaactggagcattgcagtgaactttttagggtttgtattaacagcaggaaggataataacccccaaagatgtccaagtctttatactcagaacctgtgaatatgataggttacacggtgagggagaattaaggttgcagatggaattcaagttgcaaatcagctgatcttatcatgagagattatcctggattatcaagaaggacctaatgtaatcatagggtcctagtaaataaaagaggggcgcagaagagaaggtgggagtgttgtggtgtgagaagaactcgaccccctagtattggctttgcagatggaggaagggggccatgagccaaggaatatgagtggcttccagaagctggaaagggcaggaaatcatattctcccctaaagtctctaaagggatcacattgttgctgacaccttggttttaacccagtgaaacccattttaaatttctaaactacagaactgtaagatactaaatctgtgttgtttcaagcctctaaatttgtaaaactttacagcaatagaaaactactgcaggcatggacacatgagcaaattatagttcgcccagatactttggctaaaaataagaaggactcctttttttctctctttttccctaatgatactaaatataaagtaatcttatgaccgggagagattttgcccaaaaatgaaacctacccagaggaaaccagagtgaagtataactttgtgtgaacatttttatctaactattcctgaaattaaaagtagatatttcagtttctgggagaaataaaggccttatttgtcctttagccagtttgagttggatttatatcacctgcaaattctttaaaaaaatcctaccactggcatggtggaataaataccatttcttgaaatatcttattccaatgctggatacttttgctattatttcttttaaaaatagaactggaattggctatcgtatagcttcagtcattgattcttacgtcctgaggccacacaggacaattttaactcctatttcaccttgggagatactcgggaattgaagtagtgatcctcatcaagatcctcaaatcttcacttctccaggttaaatcctctcagttttttccagaattgtggtaatatggttttgaaccttttcactaccctgtggttaatcttccctggacacacttgatgttcacaacgtttttcttaaagataacactacaactgagcacagtattcaatgtagtgactattcaaatcagaacatcctgtcctcggtgggacacgtttattgatgaaatctaaattgaggctaggcacagtggctcatgcctggaatcccagcacattgggaggctgagacaggtggatcacttcagccctggagttcgagaccagcctgggcaacgcagcgaaatcccatctctaccaaagatacaaaaattagccaggcttatgacctggtctcaaaataaataaataaatatttaaaaataaaattaaaaaaagaaatctaaattgaaaaaaatacagtttatttatggtatccacataatactgttacttcacttagtttcttgtccagtaaaatctacaatttttttttctaggtgatactgagttatttctctggtccaatctctacatttaccccattcgtaaaaattatgtcttgatgtacatagagatctttagagttacatctactgaatttcattgcaaagagaagtggatagtgagtaaaatacaggatttgtattcagacaagtctggattcaaattctggctctaccactcatggctgcctgatgttgggcaactgcataatttctccaaatattagcttcctcgtgataaattactgtgccttcctcataccactgttatagaaataaataacataatgcatggaaaatgcttggtgtagtgcctggcatgtactaagctaccgaatatagcaccggttttatattcaatcagaaaaataaataggtcagagctttcaatcttacttccgaatatacaagaggaaaagttagggtgagagaggaataacaaaagagaaggagggagaaaataaaaacacaactggtcttccccatattctcggcttacatccaaagtcaaacacagctagtcttagaaaacaagatatccaaacttacttaatactggaagtgttaggcttaacgtttttgtttgcttgtttgcttttgaaaatgggacctggtaggtgggaagtaaaaacgttcccttagaacaaattagataaatacaaagaaatcacacacatagtggaggaatgaagatgtttgtaagttgatatttcggaaccaaacttcaggaaggaccttggcaacatctaagctgagatgttttcctcctataagtaagaaatgtaggctcagagaatgaaagcttttttctctgtttcaactagaaaatctcacagctagaagaagtcaaggtcatttttccccttctgagcccaaaatccctggtcaaaggggccatagaagaagtctatttaagtttgtctttctccagaagcagttcagaagataggaatttgactgtaagtggcttacttggaaagtgatttcagaaataactattagaggagttaggaaacaaggcagggaagaaaaagaaggccataaagaatagtttataaagccagatgccactgtgggcaacagaaggtgcattgtgctggggcattctgagaacaacagaaatgcctcggagatagcccactggagtggcaagggaggtgaggcatctgttaaccaactcccaacaatcagcagttaaggactgtgcttgaaggtccagtgattcccggcactgcagccttccccaggcatgggcagaggggtaccgagctgccaaagaacctctagccaaagagtcacatgtgctggcaactgaaagtcaagccagcattcatggagagggtcagtgttgagggcatgtgggctggacaccaagagtgtctgctataaaatccaagtggaaatgagacagaatctccaatccggcctaaatctgccaaccagcaatcaacaaactcaccaaccaattaagaaataattacagctactagctgtgctgatattctaatatgttaaagatacagaaagaacattcaagtgctttatcactccactgatgcaagtagtcacatcactacacaatggttcctcagaatcagaaaaaattgaaagcaaaatggtaaaaaaaaaaaaaaatctcctaatattttagtggataagaggtgggattatcgaatacccttaggccataaagaatagtttataaagccagatgccatgttaactcttgaatgctaattcctttctggaatatttcctataaaacttaatccttcaggaaccatctaaaaggccatctcttccataagatttgctctagtggtaaaatgagctaatctgctaggcttaactccctgtgacctacccagatccctaggttgtgccagacagatgcagtttatacacattcctgcacttcctcatccttgagcttcaaatcagacaggttttataattaagatattgtagaacctcactaaggattcaagctgctctaaatgactgcccaaagctaagggcacagccaagggaaacatctataactccctccctccctaaatgccatgggatccagtaataagcacgcctacaaagcaaaaaggaagcacacatgcaacagaaactcacaaacacacacacacaaaaacatacaaacaatctggttacaaaatatatcttcaccagcttctacaactagttgtattttaagatgaaatatgaaaaaaaaaattggcaagttaggtgttactgctccatgctgaccttttcctagtagagttaaaagagccaccatcaacattagaatgcgaaggttactgacagtgccatggagatgccaacttgaaagtccccatctcagaaaaagaccagcaaggctgctgagcatggtacgtcccttttctcctagataactacactgacccatgtctaccacctgcaaaaaaataagttgcctttaataagtgtgcattttttctccttcctttcatattttttgtaattattattttcgttttgctttaaaaatcacttttctccactagggtaataaatcactgaagacaagatcaactgatgaataataaaattagtgggtataaactttttagagaaacaagatatttgtagagcctcaaattatctcccccaaatgcttgttaattgctttagtggtctcaacaaatgttcacaaattatttgaagctttccttctaggaggtggatcttaatccccctcttcttgagcgtatgctggatttagtaatttgtttctaaataatagagtgtggaaagagagaaacagtaacttgagagtggagaaacctggcagccaccaccttgtacaagtcatcaagtacataattagtcggttgataccatgtaccaggatggaatgagaagagcacttcatctttgtggcattctttgtccaaatctggagaccctaaactaattccaaaaataaaaataaaaatcagacaaacccatatggagggacatcctacaaaatacctgaccagtgatcttcaaaggtgtcatgatattaaacaaagaaaggctgaggaggaggagaccatggagacatgagagctaaatatggtatcctggattggatcctagtacagtaaaagggcatcagtggagaaactggggaaataatagcaaggtctttagttaatagtgttgcaccctgggatcacttggtttaatctcatcacattagagacaggggaaagctcagaaagaagagacttgaccacagacactcagcagttcatttcttgttaatatctcagtacatacacatatactatgtttatgaaagatattaacactaggggaggctaggtaaagagtatttgggaattctctgtgccatctttgcaaagtttctgcaaatctaaaattatttccaagtaaaaaatcttaaaaaatgcaaaaacaaataaacatcaacaaaaaaattcctcctcccaatggtgtggttacaagccttggaatggggcacctaagagctggctcctgacttcagctcactctctgactttgttgatacctttgcctctcagggcgcagtttctccaacagtttcatgatgtttcatgatgaggggaggagcggggagtgatttagtagttttcaagccatgttccccagggcacagctttgatggtatgtggggtgaactgagaaactgaagtcctgctcctgcaactcctccgaacctccagccagagcagacccactttgttgttacatatcaggtgtctatgtggacataaacaatgccaatcattgcatttcatttgatgaatgtgtttcatttgataaatagtttctgctgtaaaatgttaaaaagcactggaatagattataaatgtggttcccttctaaacttactttcattaccaccctgccaagtctttcctgaattaactgagaatgacttaaacacactgttattttcctctttccctctcttgtccattagctttctgtgggtaaaagccatgtatgtccacctgcgttcatcagtccccagcccttgtcatgaaacagtggtcgatatcaggtgaattaatgttggatggaattcctggagtcaaataacctcttggaaaataagagggtatgggataaatccctgaccccagggacttaccagcatcatcttctgggaaaaagatcttaactaagagggagcagttgtaaattattgactgaagttcaaatccaaggcctgaaccaacgttttcttcctccaggaggctttccttaatcactctggctagaagtatactttttctcctctgtgttcccaccgtctaaggtctgtgcttctgatacagtgccatcttgtattccctgaatacatgactcaggaccctgacccaaaagtatgaaaaccttcatctgggaataaagattaagtgcttaacacaagaccttgtgcatataagatgttccagaaggttgaagaagcaaatgaacaagctccaggtcccttgtttcaagcgggtcaaaacaaagctctgacagatcggggtttgaaatctaactctgccagttcctacaatgtgacattagacaagctgtaatgtctctggggccccagtctcaagtctgtcactctagttaatactgctaataaactctgttgaccaaatcacaattccaggggtctaacaaaaaacttgacacatgctgagcgggttgttcaagaaatattagttgaataactaaattgtgacctttcagcttccttacccgtaaaatagcaatacgaatacctacttcgcatggctgtggtgaattaagtagcagagcataagacaagcaatcagcacaatgcctagtgcatgacaatggctcaataaatgtttgtttttcttctagtcttttcccatcaggtattctcgccagtgaggggactgacttaagtacttctcccagccatgtgtttcattatggaggccaaattaagaatccaaggtgcttacatttcagcaaaagacgctagaccacggagtgtggcatggggtgtaatgtattcacagtagctatgctaagaaaacatctaggcccccagttgagagactatggcagcatcattagcataacaggtgcctttgctagaagaatgacactttaaagacaaatttcccccaatgcatttccccaaacgcaagagtgcatatttaattacacttaatgccatcttctcctctatttctgcgcttgaaggggacacatcaccccacaaaattggggaggttttttatagaaatggctaggatccagaactgcttcttagctccagggcccaaaggaaaaatgtcaacaatggtgcttcggggaaggaaacatgggccttatttgtttgcttgaagaacatccagctgagacagaaaatgatggaaagagcagaacacactgggacctacgagagctgaggttcagcgtgggcaaggccccgtgcgaatcatcatcacagattatttttaatgctcacagcaaacaaaatggtgtaagtctagccatcattctaatttgcatacaaggaaactgaggtttagcagatatgaatagtttttccaaggttgcatagctagtgattgaggcacttaaagttgaaccaaggcccatgatttttttcctctttatctactgtcccaatggtttcacttttggggcacatactctgcaagaggcactgtgccacaaatttcatatacatcttatctcactgaatccacatgcccattggatagtatttttcctattttacagaaaagaaagccgtggctcaaaaagtgaattaatttgccctaaatcacaagtagaggtaataggaaatttgggatttaaacccaaatttgtccaccttttatcctcagtgtcacattactagctgtgcgagtttgaaggagtaaattttcatctctgggtattagtttttcttgtttaaaaaaatactttttatggtggtaagaaaacttaacatgagatcatgagatatactctctttacaaatgtttaaatgtacaacacataatagtttgctataggtgtaatgtggtgcagcagatccctataacttattcatcttgcttggctgaaactttatacctgttgggtaatagctgctcatttctccctccctctagtctctggaaatcaccactccactggttgatgttatgaatttaactacttgaggtatctcatataagtggaatcataaagtatttgtttttttgtgacaatgagggtcacagagacattaaatggcccttgtgcctctaacatgccacagtttcatgagtttctttgtcattaacttttccctatttgctaccacagggcattcctaacctttcaattatccccaagggatacccctgtacctggcataaggatgtttggtctcaccattgagtggctctgtgatcttggacatgataaacttttctaaacttcaatcttcccatctataaaacagagctaatactaatgacaaaagctacaatattaatacctaattgttttcaggataaaatgcaatagtaaatgtgtggatattttcttgaatctgccaaagcactgtacaaatattacctagcattattataactattatcacttaagtggaatgcattcttttaaaagtgattaacttttgtcaacatagagttgattcgtgaaagtataaatggtcctcattgacccatacatgaaaatccttgttttctaagatcttctcttcaaagcttctcactcagctttgaacagatactttcaaatggacactcacggcattttatcaggaagatgagaaaatgttattttagcatagcggctactagcacagacctgggattcccacatcctggacttgtatcagtccatttttatgctgctgataaagacacaccagagactgggaagaaaaggaggtttaatttgacttacagttccacatggctggggacacctcataatcatgatggagggtgaaaggctcttcttacgtggtggcagcaagagaaaatgaggaagaagaaaaagcagaaaccccaataaacccaccagatctcatgagacttattcactgtcatgagaataccatgggaaagaccagcacctatgattcgattacctccccttgggtgctcccacaacatgtgggaattctgggagatacaattcaagttgagatttgggtgggaacaaagccaaaccatatcattccgcccctgacccctccaaatctcatgtccttacatttcaaatccaatcatgccttccacagtccctcaaagtcttaaatcatttcagcgttaactcaaagtccacagtccaaagtctcatctgaaacaaggtaagtcccttccacctatgagcctgtaaaatcaaaagcaaggtagttacttcctagacacaatggggtacagatatcgggtaaacacggctgttccaaatgggagagattggccaaaacaaagaagttacagggcctatgcaagtctgaaatccagcagggcagtcaaattttaaagctccaaaatgatctcttttgactccagatctcaaatccaggtcacgctgatgcaagaggtaggttcccaacgtcttgggcagctccacccctgtggctttgcagggtatatcctccctcccagctgctttaatgggctgccattgagtgtctgcagcttttccaggtgcactgcacaagctgttgatggatcttccattctggggtctgaaggatggtggccctcttctcacagctatactaggcagtacccaagtagggatgctctgtgggggctccaaccccacgtttctcttccacactcccatagcagaggttctccatgagggccctgcccctgcagcaaacttttgcctgggcttcaaggcgtttccacacgtcttctgaaatctaggcagaggttcccaaacctcaattcttgccttctgtgcacctgcaggctaaacaccatgtggaagctgccaagccttggggcttcaaccctctaaagccacaggctgagctgtacattggcccctttcagccacgctggagaggctgggacacaggcaccaagtccctaggctgcacacagcacaaggaccctgggcccagcccacaaaccactgtttcctcctgggcctctgggcctgtgataggaggggctgctgtgaaggtctctggcatgtcctggagatgttttccccatggtcttggggattaacactaggctctttgctacttatgtgaatttctgcagccagcttgaatttctcttcaaaaaaatgggtttttcttttccactgcatcatcaggctgcaaattttctgaactgttatgctgtttcccttttaaagtggaatgcttttaacagcacccaagtcgccacttgaatgctttgctgcttagaaatttcttctaccagataccctaaatcatctctctcaagtcaaagttccacaaatctctagggcaagggcaaaatgctgccagtctcttcactaaaacataacaagagtcacctttgcaccagttcccaacaagttcctcatcaccatctgagaccacctcggcctggaccttattgttcatatcactatcagcagttttgtcaaagccattcaacaaatctctaggaagttccaaactttcccacattttactgtcttcttctcagccctccaactgttccaatctctgcctgttacccagttccaaagtcgcttccacattttcagttatcttttcagcaactcctcactctactggtaccaatttactgtatttttagtcctttttcacatcgctgataaagacatacctgaggctgggaagaaaaggaggtttaatttgacttacagttccacatggctggggatgtctcttaatcatggtggagggcaaaaggcacttcttacatggcagtggcaagagaaaatgaggaagaagcaaaagtagaaacccaataaatccaccagatcttgtgagacttattcactatcatgagaatagcatgagaaagatcaacccccatgattcaattacctccccttgggtccttcccacaacacatgggaattctggaagatacaattcaagttgagatttgggtaggaacacagccaaaccatatcagggctctagtctgagctccatccattctagtagaagagttttccctcctgaacctcagttttctcacaggtaaaggttagttaacaacagccttctcaatggagtgctgtagagattagataagggacgagtgtgtgaagtgtttagtgctattcttgggacataaaaaagactcaggatatggtattattaataacaaagttttactgatgcacaaacagcagcagccaaaaagacggggccatgcacatgagcacacagaagcagaacaggatggctcaggtgtccattttcattgcccattcctccatgccacctgctctaatatataccctttcacatggtgttaaaggatgaaaaacgcatttgcttaaaatccatctgctttttataacttccagagaccaaaatctgcacaagcagcagttctttgtggctcctaattaattcctaaacaaagactgctctggcagcagcccagtttatcaaaccaattgacctcctggtgcagaaatgatgacacagatgttgttgctatgtcacaacctcatttttcactttgcatcacttggtcaggccagacatatcttcaccttctgaggagtagaagatagtcccctgggtgactctgagaccctaattgttatctcccatggttatgggcctttctccactcaggcgcctcccaacaaaagtctggagtggaggtctggtgtggtagctcacgcctgtaatcccagcactttgggaggccaaggcagatggatcatgaagtcaggagatcgagaccatcctggctaacatggcgaaaccccgtctctactaaaaatacaaaaaaatagccggacgtggtgacatgtgcctgtaatcccagctactcaggaggctgaggcaggagaatcgcctgactctgggaggtagaggttgcagtgagccaagatcgcaccactgcactccagcctgagcaacagagcgagactccgtctcaaaaaaaaatagtctgggttggaacaggccagaaaacatcacctgtctttggttaatctgagggcttcccaagctaaggaatctctaatctgtagggttcttgggaggctaccagtaataataatcacagtggccatgaacccagtgtctattatgtgccaggcactctcctgtgcattgtgcctgctttatctcatttcattccacacaatctttgaagatatgagttagcatcttaaattcaaagtcaagaaaacagaatattggagatatgaagaaaggcttcacaacactggaggtgccatggcacttcgtataggtgagttaccaagaacttctttcaagttatctcatcaaggcctcactccatcactgtaaggttctgacaggttagacaactatttccaggtcatacaagtagtaggccaagaaatggtcttcaaaaggggtgggcctttcctctgagttagttgttcttccaattggattaggaactcactcttataaccccagataaccttattacctccttaaaggccatatctcctaatacagtcacgttaggggttgagcttcttaatcaatatgctaatgaagacagcatgggctcaaggctgaatctaggttttgggtggttgtgtgaccttgagcaatctcaggcttttcatccagaaaatgagtatattcttacacatttcatctgtgaataatcattaaccaccaaagttcttgccattgtatatcaaagactgcctttcctctattctccaatatcatcttcctcatttccatcagaaacctcaccacatgcacctttagcatccattttttctatcaacagtgttttcaaagcaacctaggcttttccaacatgcacttcaaaactctttgcggcctctacccattacttaattccaaagccactttcacatttttaggaattttttttacagaaacaccttacttcacagtaccaaaatctgtattagtctgcccacactgccatcacagcatactaaaaactggatggcctcaacaacagaattttattttcttacagttctggaggctggaagtctaacatcgaggcaccagcaggattggtttctggtaaggcttctgctggcttagagatggacaccgtcttgccctgtcttcccatggccctttctctgctgtgggtgtgctttcactgatgtcttttatctctccctctttttttttttttttttttgagacggagtcttactctgttgcccaggctggagtgcagtggtgcaatcttggctcactgcaacctccgcctcccagattcaagggattctcctgcctcagcctcccaagtagctgtgattacaggcatgtgccaccatgcctggctaatttttgtatttttagtagagacagggtttcgccatgttgaccaggctgttctcactcgaactcttatcctcaagtaattcgcctgcgttggcctcccaaagttagtgtctcttctcataaagacacaagtcctgttggattaggagctcactcttataaccccaaataaccttaattacctccttaaaggctgtatctcctaatacagtcacattaggggttgagcttcaacatattaatttgcaggggaacacaattcagtccataatatctgccattctgactgaaaacacctgcttaatatattgtcaggagattttaatgaaattttaaatgggatcatgttctattaatgttagttggtcaagagcatttgagcttcaagaacagctacaatttattgagaaatttctatttatcaggcaccaagtctgtacttaacatggatgcttccatgcctcacaatgattttatttgagaaggtattattgttggcactactttacatttgaggaaaccaaggctcaggagaaggcaagtagctagcccaagatcacacggttatcaaaaggctgagagatcccgtccaacagactctcctctcccatactaggctgttgcaatcattctgatggcccagaccttccctgcaagtgggaatccttcacctgagaacatctgctaccacaagagagaggaactgaccctcatctccccccagacagcctctggtgactttacacaccatctaaacaaagcctctggcacagccaccaacatatttcactccctattaaggaaagctgagacagggcaggcctctggacacttcattaggggaacatcaggacacataaggactgtaataaaacaggaaccgaagagggtgtccatggggaaagcccggagctgcttgtgcttgtacccctgcagaattttagaggaggaagggagggctgagggcacagagagacaagggcgggggagagggggatgagataaggctgccatgggaaagcaagagctttgctgccaacagagcaaacacaggatgtggatcccagctcagtctctccctagctgtgtggtcttgggcaaggccatttcacttgatgtaccacaatgatccaatccataagatggagatatcaatgcttgccaggtgggattttgtgagaattaaataataattttaaaaattagcatgttaaggctgtgactttccccctaatggtttcgatgaactgtaggtggacatgagggcgatctggctgcaacatctgtcactccattgacctccagggttgattcagctgatctgtctggcaagggaggtgtcctcttcccccctcactgctctatgtgtgtccctcccaaagctgtatgctccgttgaagaggatggccatccccaatagaggaggactgttttttggtcaagggcatacagtagctgcacgcccctgctagaacctccaaacaagctttcagtgagctgtaagtttatgattctccacctttgtaaattccccaaaacctctaattggtgttcagatcaggcatacatagggtaaggttcaggaaactatcttttaaacaaacacacaagagaattctttttgttgttggtagtggtagtaaatttattcttgaaaccatttcaatgagatatattaacatgtaaaaagctgtgcatatttaatgtatataactcaatgaaatggaaccttggtgccctgttagtgggaatgtacattggtacagccattatggaaaacagtagataaattcctcaaaaaattaaaaatggaactaccatatgatccagaaatttcaccctaggtaattcttatgtaggaagaaaatcctgctccacacctagtgaaataccaacagtaaacaggagaaaataatatcaggcaatttttaaacctcctagtaatagtggtagtgcaaggactttagaatcatgacacttggttaccaatattatgttgcttatgtaggatgaaatatatattatctatggattttagtctcctcctaggtgatctgggtaaactaccctaaataactgtttcaagaaataagtaaaataatgcacataaacttccctgcatattccccaccatatggtaagtgctcggtattatttctctgatagattcattttcacctagctcttgcaaatgacttgtaataatccctcaactgtggaaaacatagacacaaaaaaattttctacctcaattccaacctcacattttgtttaataaagcaatttacagggggtaaaaataattagtggttttaaatgctttaatacaagcaggcgctgtaatcatgataaatcatctctgacatatgcccagctcctccaagtgacagatgacaaacaaaagcaggacaaggtcctccgtcacaggcggaatcattgaattaatggaagaattattgcttctgaaatccactccagtcctattgaggagaacgttccaatttatcaaagccaaatgaacattaattgcagcagtctggtaagttttccagccactatgaccttcattgaattttaatccaaaacagataagatttccttccacacaagaggaaacaacacaattagctcaaaatgacagctagattatgaagcaggcacacacaaacaacacacacacattcacactcacgcacactcccagtgaaaatattgattctacttgacttaaaattcagcacaaaggaggtgagcagagaaaaaggtaaataaataccatcaccacatctgcctaaccccttccccctcttcattcaggagagaaattttagaggcggaagccaagatggagaaggtggcaggcagtaatggagacagaatttctgttaactgctgtaattaatgttatgtctcatcagggagagattaggaaaaaacagagaaggaaggaagaaaaaacaagtgttattttgctattaaagacgcccttgagctgggaacattagcagccgaagtttgaattgggtaattgtttgactgtatcggtggatttgcagacaggattaccacagtgaagtgaaatgtagttgcgctgaacctacagcgtgagtggctccctcagcatggagcaaggggccttctgctgggtgcagtttatagcctgacacaggcacactgccctgagatttagatgggaaggccagctctgtcatcaacctgctgtaagacatcgtgagtcaccctttgagacctaaaagctttgtttttgtatttattttcactctattaaaggggttgaactggagtttttaaaacgcttttgttttttgagaattaaatcagaaatttctgttttcatcaattctaaatatctgtggccagaaagaactggctgccttcttccatggtccagggtcaggcttgcctcaatatctcatagtctcgtaattggatgattatggagatgagctcctaaaaagtccttatccatccttgccccctataagaaaggaaatattatacagcagatggagcagagagctcatttggaactagaaatatatgtttaattctgggctcggacactggctatgtgatcatactagagagttgtcttaaccttctagaccttggttttatcatttgtgaaaacggaacagtaaaaacagcaatatcaatagtatcattaatacaacatttgtatagagtttgcatatttaccaacttttaactgtagaaactattactctcaccattttacagttgagaagacagaggcacagagaagttaagtaacttaaccaatgtcactctacaagttacgtggtgaggccaggattccaatccaggcagttctgtcccaaagtcaacattcttgttttgggttttagcctttttattttgaaagaattatagactcacaggaagttgcaaatttaggagagagctcttgtgtactcttcactcagcttcccccaatgtcaacatttttcataactataataaaataatgaataccaggacattaaccatgattcaacactattaactaaaccacagaccttatacaagtttcacaaatgatgcctcttccagcttatggtagctcttggttttccttggcttgggctacataatgctcatttctctctccatcttcataccatcttcccctgtgccttctcttccatgtgtctctcataaggactaatttttttaatttttttcactaatgtccttgtttttccactaatgtttttattttggtccaggatcccacattgcatttagttgtcatatctccctagtttcctccaatttgtgacaattactgttttccttgttgttgtttttgttgtttatgatcttaacacttttgaccattgcttgtgaattattttgtagaatgcccatcattgggtttgtccatattttttcatgattagaatggttatacatttttggcaagaaacccacagaaatgacattgtccttatcagtgcattacttcagtggattcataacgtcaatgtgtctgatgagtgaggatgttaattttgatgacttggttaaggtggtgtggtcagttgaatagtgggtcccagaaagatatgcccacaccctaatccctggagtttgtgaatgttatcttatttggaaaaaagggtctttgcagatgtaattgagtaaaaaaatcttatgtataacaatctgagttatcaaggtgaaccctaaatccagtgacaagcatcctaatgagaggcgcatggaagaaaagacacaggagaatgtagtatggaggcggacgtagaaattagcgttcaatagcccaaaccaaggaaaaccaagagctaccataagctggaagaggcaagacaggattctcccttcgagccccagggagagtgtggccctgccaacaccatgatttcagacttctggcctccaaaactgtgacagaataaatttctgttgtcttaagcttcttaaattatggtaatttgtcacggcagccttaggaagcaaatacaagtggtatcggccagatttctccactgtaaagtcactattttccttctgtaattaataaatgtcttggggggagacactttgagactccacaaataccctatatcttctcaaaatttcaccattaattttagtatacatcagtggatcttgtcagtagtaattattacagtggtgattgcctaatggtgattttctgtttccctctttccttctacatttattaactggaattctactgtaagaaagagcaatcttttctgccccatttatttatttagtcaattatttatatcagtattttaaagtcaatattcttaataacctcccaacatagctcaaaggatgtttgtgaaggccaagaacgataacagagtaggaagaatatttttagaggccaaaggagaagaaagggaccttccctgggcaccttgctgatgcttcatgagccttttatcacttattcctcccctcagccccatgaatgtggatctctcgcctcatttacagctcaggagaaagtgaggttcagaaaggttcagtaatgtgccaaaggacacacagcagtaagggaaagaatcacagtttaagtcctcatctgtcttgtctccaaaaccacgtgattcccaccaaatcaagctatgctctgaagactgggaaggagggagaaaggtggattaattgaagggagaggcagaagttccaatatatccaaatcaaagctcactttccatttttactgtgggcttatttggggcatatgagaaagggagtaaacagcgtgaacctcactgcaaatgtgctcacagcattcattttgtgttgctgttaaaataccacacaaaagccccaggttcttgaaggggaggaaaatgtggaacaggaggctggggcagaggaagttgggaatggtcaccaaggggacacacgccctgactctcttgccaacctgtccgcccctccccactttacttccctgcagtctctggatctcccctctccttcccttctcccagactccctgttgcaatccagtccaccctgccctgccatggcctcttctcagatccacagtgctgggtgcccctgcctccagccctctcatctctgctggatgctgtctgggcttgattgcctcctcagcctcggatcaccccgattgcccgcccttcactccatctacctcgctacccgactcccagccctttcttgaggttgagttccatctgcttctcttactcgctgtctctctcttttcctgttctcttctctctgtatcacttcctccatgctttttattctctgtttcattttcccccatctctgcttttgttgctaaatccctttctgtctgttcttgccaattctcctttatttttctatgtctctcccatccttggtgccccattctctcagtttcttctttatttctctccgtctctagtaatttcaacgtacctagtatagaatagtttctcaatcaacatgggttggatgtttctgtcggtattttcttctgcttccctctgtccatattatatatacatagctatagctatacacgttcttattctgcattgtgctttggccaggaggttcagtggaactgccttcaggcccttttcctgagctgcctcttgccatctccaagatacccttgtcaaacttttccatctgggctttatcattggcccacactaatgggacagggatgaagaacatccattctccagcttcattttccccatctacaacatgaaggtggggtacattctattgctgtggcaattgcttgcatgtgcaccccctgtaaaagaattgcacacccctgccattggctctgggcttggccatgtgatgtgctttggccgatagaatgtgagagaacccacatctgagcatcagtttcaagaggcatcctatatttttgccagctctcttgctcattccctctgccatgaaaaccaaatgtttcaaactggggctccccttcagccaaagtaccagaaggagaagacaagcagagctgagcctgcagtgactgcagctgccgatgtgtaaggtgcatgagaagtaaagcatggtgtggccaaggcactatgatttagagtggtctgtttgcagaataaacaagcaagagctgactagcctggaagagttggatattctatgaggtctcaggtgttttcagctccaagatcccactatatttcatacttctactgtttttttttttttttggaaactcttgctaaatggttttatgtgcattaagtttgatgttatgattttaattttatttccattttgcaaatgatcacacaagaaactcagagaggtgagatgactagcctgcatttctatagccggtatgtggaagtctaagcttgaaaccaggcctcctgaagccaaattccatgctcattctacttcgctatggtgcatctctaaatgttgtgaaaaataagcatttcctatatttcctacacatggaagctatggcttattttcctactttgcccacaggcctagctagagaccctgcaggcttttagtgaaaccatgttgttgaagcaagtcaagaccaagccacaaggttcatgtgacttaaaattttaaagtattttttaaagtctatacttacaatattaaaagttctactttctggaaaaaaaaacgtgaatgatactcatggggtatgtcccacttttgtaaaaaagtacttgggatatttgtgttacaaaacttcatcataccttggcaattgatataagcttggtatcttcatttttagatgggtgcagtgaggttaagaaggggatgtgacttgcataagatcatggagcatattggtggcacagcagagacacataactatttgtgctgcatgtattacatggtttttccactactagatgtttgccatcctcacattttaaataatccctctcaggatctgttttccctactactctgtcttttctctgaaaagcatttgggaatcacagtctgtaacagcttggcttctcctaccctagttgtcctgagtgaccttcaatgatattacttataaataacatggtggcagtattaggttgatgcaaaagtaactgtggtttttgccattgaaagtaatggtatttctcaaagtttcaccattaattttagtatacattggtggatcttgtcagtagtggtattattttcaatggcaaaaaccacagttacttttgcaccagcctaaatatttattgttttcagttgaattgggtcctccaaaagcaatatgttaagctcctaaccctcagtacttcagaatgtggtgttatttgaagacagggtatttataaaggcaatcaatttttaaatgaggttgttagggtgggacccagtcagagtgcagcggcatgatctcagctcactgcaacctccgtctcccagacccaagcgatcctcccacctcagcctcatgagtagctaggaccacaggctcacaccaccaaggccaactaattttttgtatttttgctatagacagggtttcaccatgttacccaggctggtctcaaactcctgagctcaggtgatacacccatctcggcctttcaaagcggtaggattacaggcttcagccaccgcacctggcctctggtgtcctcataaaagggggagaattggggcatagagacagacatcacatgggcagaatgccatgtgaagatggagttctgctgccataagccaaggcactaccagaacctagaaggaaagcctggagcagatctttccctggtgccttcagaaggtgcatggtctcacagatatcttgattttaaacttccggcctccaggattgtgagataataaatgtctgtcttttaagccactcagtttgtggtactttgttattgcaaactaggaagctaatgcacttataagtagcagagtaatgacatttatagaaccagggctgtgtgtcaggctccagcatatgtgctttatatctatcatctctgatgattctcacaacagcccctctttagacaggtaattccatcagagaaagtacatgctcaaatcccactactaccaagtcagttatggagccagaatgtgaacctcagaacacacagagtcacaggtcttacaagttagttatacttcctgtgcttattttctcaacagtagagcaggagtaataatatctattgagattactgtaagaatttaatgagttaaatacatgtcaagtacaatcacactaagcactgtaaaagtgcttgttagcattattaagattcttcaatgtcttgattactcagttattatttctactcagttactgtttctcttaagatatggccccaaaaataaacacaatatttcagttctcgcccagtacctctagaattatttgttcagaaacctagccttttattaattcaacttaaaatataagaccactttcagcaatgagaccccatagttggctcaatctgagctggtggctgattttgtaaaaagcttttttttttttttttctatctcttttttttctagcagataggcttttcattgctagatttaataggcaggtaaaccattccatgattgaatgattaaatcaatgaatgaaggaatatgctatgaatgaaaaaacgtcacggttggagcaatgatataaagccatcttttacagaaacctttaaaaagtgttatcccaatatcacaccgatcctctaaacaaagctactgaataagaatggtagtaataatttcttagatttgtgtgacattttatattcctcaaagtattattctatgttattatatcacagagtcatagatcatctaaattggaggcaactacaatagtcatctaatttaactattattcctctctaaaccccagtgactttgcctgcacaaactcagggagaagaaacccacaacttcttgattcggcctactccaccgatggatagctcagacactttgaagtgtttgtcctgtcgtgcatgagaattttgacctcttggaatcctgaatcctccctcattggaggccagcaatacaaatccgtggcattttctttgggatgatccttctgagagaaacatgccctcaaaattcttttcttctcctacatcaaaccaaacatttcttttcatcccctttctcaaaacattttgtcaccacaaagacaaaagggaaaaaacaaaagcgccaagataaaacatattggtctcaaacagtttctatctagtaactcttgtggaaatctttaaaacaagacacatcacattaaaatgaaattatatttctcactgttaaaaagggggagaggaggaaagagtagaattatatgaccaaccctctgaaccacaagtgataactatttttgttgaaagcaactttgatctatgcaaaagtgaaatatatattgaaatgccaatgtgacaatggcaatggcaacaaaaagcaaaatgaaaaaaacaaataaatgcaaaaaagaaacaagaagttgtgatcacatctgctaggacctattgcatttcctcatgcctgcgtgaagcagataaactcttcccactttcttttttttttttttttgagcagagtctcactctgttgcccaggctggagtccagtggcgtgatcctggctcactgcaagctccgcctcctgcctgcaagcaggcagatcacgaggtccggagatcaagacaatcctggcttcccactttctaaataaggataccaacactaaaagaacctctttctttatcctgcaagtttgcatatgtagatcacaaacttagctggcaaatagttaggggcccataatagcttgttctgataaacaatgtaaagtgcaccccaggattcaagccatggttttcctctgactttgcacctgtagtcaaatcactcagcctgctttggatttcttttctcctatctataaaatgctggcatgagcaactcctctccctaactgacaagtttccaatttctatcaaatgttttgtgcacctggagtgaatactctataaaataacagacatgataaccctcactatagctaacattttaataacggctactgctttttgagcacttacagaatgtcaggcactgtgccatgcagaactgtgcccaagcacacagactctcagtttggacagaccagagttagaatctcaacttcagcacttattggtgatgtggatgggcaagatgcaaaaatcccactaactcctaagccctcatctgtaaatgaagggcaacaacattacttatcatatagaggcattggaacaattagatgaaataatagaggtgctgcacttagtgcctggcatacagaaagttctcagtggtggcagtcattattttcattgtgcagggcatttgtgagtgtgatctcattccgtgcctagaaaaaaaatctctaagtattggggaatattattccagttttacaaatgatgaaggtaacttggccaaggacacaaaggtagtgatagagacattattcaaccatggagttgatttccaagtcataaaccctcataaaatacccatggattccacatagggtacagtcttcgtaagaattcactcatgaaatcttatcaatttaaatcaacaacggatgcatagagaaggaaaatggtggcctgttatatagattaagggcatagtttctgaaaccagcttatatagagtgaaaaattgggtttgccacttaacctttgtgtgatcaatgtcacgtagataggtatttattaacatttcagattcctcatgtgagggacagtatccatcttaaggtttgttgtgaggattgaaagtgataatatgcagagaacaaaatttggaacactgcctggcatacagtaaatactcaaaataaatgtcaggtattatgattatttctctagatcaggcagcaaaatagcagcaaatataagactaaagccaatgtctttttactcctaagttgaagtcctttaaacattgcttcaatgacaatattaatagccatttgtgactatgcactcagtatgtgccagcctgggtattaggcaccattgtatgttttttccactcttttctccactcttttcaataatttttctccactcttttcaataattctgtgagattggtatgatcagttttgtttcatacataaggaaactgaggctcagaggcatgaagggatgtgcctaacgtaaaattaccaggaagcaggaagtagaagagactatattcagagccaggtctgctgaattccatcgctctgctttttttctctgcatcctgccacctgcacagctgaggagggtatgctgaagctgaggcagaggacaagaggagatgactgtttactctcactttctggactaggttcagagtacttccttgctgcatcaccttttgtgatattaatattcagatgatgcaacctttgggacaaggtagatgctcgactctagccttcacaagcctacaaagcatgatggctccaccccaggaggcatggatggtagcaggttccagtggctgaatgggagctggtttccctgcatgggtgagcaggatatctgtgctgtcaaaaggggatggagtgcatagaccctagcctccagacttctttgagatttgactagaagatttgggtcttctcacaaaccaccttggatcttcaccaaagatgaaaacaatagtgtatccagcagggtcagggccatgatgtcatgaattgccagacacaagttttaatcctggggaaatcctggccccagaactgcctttttgttagcccaggagacttagacaaatcaattaaactcatgaatctcagatttctcagttgtgaaatggggagacagatcccagccatcttaaatgtaaacactctttttgttcttgctgcattgtctgtggccagaatgacaagggtagagtctgagccacagagaggcctgacctccaggccaagccctgctgactgactgagggatcttagacaagtcctagcctgtcccagacctcagtatccaactatggaataaaagggtataataaatcagcacatctcaagtttttcaactaaactgcccctattaacaaaagcaaatacccttaagtgccaagctcctctgatctgaggacttgttgtgtctacataactattagtataatccttgttctataaatgacaaaaacaagacaaagggctcatacccgagttcagtgtcagagagagacctcaagtctgtgctccaagtctgtgcttatggctgtcttcctacctctagagagagcagtgttattggcatgccccacctctcagaggaagaacaccctggggttcagtgtctccaagacatgactctgttccctgaggggagggcagggacaggagagatccagattatggagccctgaatgggggaaggaactttggaccacacggtggtagccttgggtcactttggctcatgggtggggagggtctgaagggtgccagcttccacgttacctactctgccagccaaatctggaactacagggaatttcagtgacatctgggtcttagtgagttattatttcgaagctgaactcactgagcaaaagggaaagttgaggaaaacctaccatcctggggagaaagtctgattcagtgaaactaacactggacctggaagcaaaaaagacacattggaggctcatttataattgagataatactatccaggttactgggttacaagaaggatacatgcaagtaaatgtgctgaaacacagaaaatgtttaatgaacattggtcaaaattgagtctcactctcaaatgttaaaggaagaagagcattcacacccctccgcctcttcctaacattagatggtgtcccacaccccatgaggaactcagcaagtgccctgagatggtgcttataaatttgcaccccaaacttagcatgcaggcacccacttgcttggtgtgaggctgcatcatttgctaaatatacatatggaaaaagtctatcacactcattccatgaataacacaaaggccttgatttgttcctccacgtgatgagcatgcgtaaggtccaaaattaacattgctgtctggctggggagtgtatgtgtttttccaaaaagagaaaacttctaagatcttactcagccctaatcagaatgtctaatgcacagtgttcgttgaagagaaacgagaaagagactaaaactaaaggtcgctccgttgtggagtctcaaaaaatactgctgattgttaaattgaaggaagcaatgagggttgagaggtagctctgctctgctgagtggctttatgccaatcacttcacccctctgggccatagcctcctcatatgtatgttggagataccatttcctaaccttgggtatctggcagagccgtactaaagaagaaaaggagaagtgaatgtaagaggggctttgaggaatataaagcatcagaaagatgtgaagtttcttcctgagcccattagactctgtgctttctacctactggatttattttctggttttgtttttctatctaccatgcaatgccaataaatatagctttttaaagaaagcatataatataagcccagatacttttagactaccactcaagtgattccagccctagtaaccttctgggtggaggcagcagactcagagttctgtatcatggggccaacagagctgaacagccacatcctctctctgcaaacatgtggaggtgattcgctggacctcatccattcttggcaagagcacaatgagataatttccatacatgtatccagtatagtgcttaacaaatggtagatactcaagaaattcttgaattgagagaaaacagggtgtacaggacatagttcaggcttagtagccagatatgcttggatttgaacactcaagagtagttccatcattcgctggctatgtgatcttaggtaagtttctttgcccctcagccacagtattcacaactataaagagaattatggaggggcttctgtggacccccacaatggctacgtccagcccagctacaagggccaccatgcagttgttgcaagggttaaaacacctgacacatcaagggtacttaggaaaaggcagcctgttctggttttattccaattttgtttgttcagtcattcttggaatggccagttgtattctgaatcaccaaacctcagccctcagcaaagcaggccaagcacatgacagatgttaaacagctattcccagagatgtcagccaaaaggccgaggagttggagaccctttattttcttctctgaagcacaattagtttgtcacagctgacagatgatggatgggtatgcatcagtccaagtgacatcacagaatccatctgattttctgtttctcattctaacctcttgagtttggttctttccttccatctgtggacaatcccccgccccctccatctctccacccattcctcccccacgcaatccccgaccccggtcacatccccccatcactcaccatcacagaaatgtggaggatgtgcatctgctcctcaacaatctccgagggctcctggagagtgggggcggtggcttgggccagctgcccggagctgctcatggagacgtggaagtacaaggtgccattctccagccactgctgtctccagtgcaccagcgagatgtccgctgctgtgccagacatctctgcaagacaagacccgaggcactgggtgagccgtacgcctggccttggtgctccagggaggaaaagagcccacataatcaggagctcagaaggcatccattttttgccaggatacctttcctcacatcaagtctatgagatagggatcatcactttcatttatagatgagtcaactgtgaccaagattcacctaaagtaacagagtagtggaagcagggtttgcacccacatctgtctgaggccgtttttagtacatcacatgtgatcaggtaattcattctactctgatagtggaatgaaactaaggataaaagtgctttcattcttttgtggctatggaactagaagaagatgaaggaaagaaatccatgaaaggagtgggagttgagagtgtggattctttagaagttgagctggaagtactcatggccaaacctcggagccagaaaggcccaagagagcaccaactcagctgaggtagctcagggtcatcttgcatgggaaaggagcttgccaagagggttgccctgagcgtgttcctcttgcttccacaagagcagctccattttttgtaaggtatatactgcactcccaagcaaggaaatgttggcataaagtttccttggcttaaaaatactggcaaagctactgccccatcccaacgttctcatatagccagtgaggagtgaggactttctagtaaattgtaaaattcaatctcccaacttgaagtttctaactcttatctctatgctggttttccttctgtaaatacttttaaagtgattatcatttgaatagtatttttgttcaatgtatcatacctttttattagtaaaaaagggtcatggcataagatgatgaaagtgtcattgcaaggggattgtacaattgttccaaagtccccttgactaaaggtgtatgtgcctgcaaatgtcctagaaagacaaggcctatcagtgaatcttatgcatgaatacaagagaagggtggtggatttcttggaggattattaggtctgcattcaagggagacaaacaggagacaaatagcctttataatgtccatcagtagacaagtagtcttagtggtgctagaggcttagaaccttgacccctccctcctgagacagctatgaccttgaggcagtattcctacagtctccaaagacctcgagtgcattcacacacacacacaaacacacacacacgaggagagctgataggcaagctgagttacagcaacttatccaatcagctctctccatgtcccactgcagcacccatcatatctgatgacacggaatgaaaaagaatcaacttgaaaagaagaggagatgatactaccaaatcacttactcatcacccaattccactgaactattcttatatcatcaatgcccaatagactctccctccttgaggttcacaatcaaaaatccttaggagaagagtgtttagcacttaataagggctaaaaaatgttagctacgaatttttaagttagatattgatttatcatcatcatcatcattattgataggaacaggatctaattcatccttcagctgctctgaaaaaaaagaaaaaaaacaacaaacaaaccatgagccatccttgacagcttgctttctctcccactcctcattcagttcatcagaaaatccttccaaagtcatccaacattcaaccctttgcagtccctctacatcagccacatgggacaaggcgtcatgctgtcttgcctggcttactgcaaggactccttaacttgactctcttcttccacccttgtccattctattctcagccaggagccagaggaatcctgccaagcaaaagtcatctcacatcactaagccctccatttacagtctttgcatggcctcctactcattccaagtaaaagacaaagtggtgagaacatagtaagttattaggccaagcaaacacatgcttgggcttcccttgcagctggaagagttgaacaggccttgagataatcacgaaggtttgtcagcacttagagcacaggccccaaaggccctgagaacccattgtcgttctggggaggggctgattgggtgatcaatttgagtggtaggtctcctctcagcaccttctcttcatcccaggctggggtgatctgctgccccactgaccccctcccagccttagcacccaaggccttggcagtagcttctctggcagacagccagctgggccaaggcaaggtgaagacattatggtaaatggtctggctcatttttctctcagtgcatcaaagcctaaaaccagaggtccagggaacccagggctgaaagctgcactagaaatagcagtgtctaattcagtagttccatgtgctgctggctaggcaggcactccacgtgctgagagtccctggaatggcaccagaagaaagctccaaggtaggctacatctggttgacacagcctggcacagttgaaggcggagcgagcagagggatgcttgtggaaatctgagctccttgctcctagcactctctccagcctgtgcctgaaatcccactattaaagaggcttcccctttccatgttcagatgagaaagcagaaggtctcagaaggttagtgacttaagttcactggtgaatttgtacctagctagaaccagtggatttccagtccatgcaatttctactatgccagttgcacttacatctcctttctcttgactaaattagcccatgaaccaaaactagattgagctctttgtttgctacagcgatgagtgcacaatcagcagacagtaaacgttaaatgataataacagtgtgtgaaacacagtaaatattgaatcacagagaataactccggacttactttattacaaagaaaagaaactgttgttgaagaggagagaggaggggtatgaaatgttaaagggaaaaatgctttagcagaagcagaaggcctcgatcattcattcactcattattcatttattcatgcatttgtttatttattcaacatacttatcaaacacctactcaatcccaggcagctcaatagctcagaacacggagttaaatgagacatagccttgccttcagggagctcataatcatttagcagtggaaattctacccagccaaatgtctccttgcccatgttactgtccatacacatacacactctccattgaccatggtccaggcaactgtgtgttatcgggactatcttctaccatcaccccttcttcacacactccatccctgcaggacttacaactgtttctcaaacaaggcagactcccacttgtctcaggccatgagtactttctgcccaacattcctagcgctctcctcccagaacctatgagctgtcttcttctcagtgtttgtctctcagtccaaatgatacctgcttggaaaagctgtgcctgtccactctagctgaagtggtcctcttcacacacatccaacctttattatatcccttttacaaaaactttctacagcagttatcatgattagaaattcaggctgggtgcagtggctcacacctgtaatctcagcattttgagaggccgaggcaggcggatcacttgaagccaggcatttgagaccagcccggccaacatggtgaaagcccatctctactaaaaatacaaaaattaaccaagcatggtggcatgtacctgtaatcccagctactcaggaggcagaggcccaagaatcgcttgaactcggaaagtggaggttgcagggagccaagattgcgccactgcactccagcctgggcaacagaatgagaccctgtctttaaaataaaataaaataaaataagaaagaaagaacgaaagaaagaaataaatttatgctttacatttccttgaacatgtgtttattgtctctctctccaggagagcagagaccttgtgtgtcttatttcctgccatctctcacgcactttggaaagtgcttggcacataatacatgctcagtaaataattactgaatcactgagttacatacatatatgtatatatatttcaaatactcatgccctttttcatctttaaaatgcttaatgcatatatatatatatttcagtgatttggtatatatatatttatgtatttacatatatttcagtgactcagtaacacacttacttgcacacatccataataaaatggtggagggactaaaaaatagaattcaaagagtgttacatttcatcagagaattaaaaaaaaaaaagaagaagaagaagtaaaggtcgattgaaaactccaaagtgggaaaagactctcccagcttgcaaccaagaactacttccagaaggtggtggtaggagcattgcagaggatggacagattcatgtccctcagagaggaggaggagaaggcatagagatcagctggtcatcgcaggggcatgaagctgcgtgtgtatgtcggagtggagcagaatgtcaggtgagaaatgtagttcagggcctggcgtggtggctcacacctgtaatacctgcactttgggaggcctaggtgggcggatcacgaggtcaagagttcgagaccagccaggccaatatggtgaaatcccgcctctactaaaaatacaaaaattagccaggcatggtggcatacacctgtagtcccagctactcggaaggctgaggcaggagaatcacttgaacccgggaggtggaggttgcagtgagctgagatggtgccactgcacttcagcctgggcaacagagtgagactgcatctcaaaaaaaaaaaaaaaaaaaaaaaaaagaaagaaagaaagaaagaaagaaatgtaattcacacacagagttaagggctttgaatgcttggtgatactgtgtacattttattcagaaccagtagagtacacttggtcagaaaaccagtcctgtgtcccttaaaaacaggttaatagaacagtaacatgaccaaaaccagttcttgagattctctgctgattgattttccaattgcattttcccttttctcttcccctactccttccatataaacatttcattgaagtctccaagtcatattacaatcaaagtttaagcaaaagggggactaaatgcattgggtcaggaaccaagatgattcccataaaggcagattatgctgacatgatgaatataaaatgaaacagcagatattaaagtgggagaattggtgcaccatgccttttggcagtaggctgactccagtgcctgcctccctcccaccctggatagcttggttttatattggaatcataaagaaacacagggattgccttttcacctttttctgctctcccccatgggctgcaactcgtgaaatattcaacaggctcaaatcccctcaactgccccacagaagctgagagagaggatcagccttcatcagtgattctgggtagactgccatcctgcctcggtggccactgatgcctttcagcctcccggaaaagaaataaaaaatcccaaaggcatgttgtgcttttaatcggcttgttcttcctaatctatggcactcattgtatttttatttaattcctgaaggtcattaagaaaataagcagctcttctcatcaccagccatcttggtaacatctcccaagtggctaactaaccggccttctgattctacagcaccagctgaccctccagcagattatttgctgaagcccagagaaagcttccaatgagtttgcaaatgatctttttctcactgtggggaaagcagacattacatgagatgaactcaccgcccgggcagaaagagttgggaaaggtagtggtgttgactttaaccaaccttgccactagctattccagcattcatgggtgattgtcacacatcaagtcttgctgagtgagcctgggaaataatcgcaaatactcatgccctttttcatctctaaaatgcttaattaatgcaaagctttatcatctctctcatgggctattgcaaatggttctgtgccagtcagggtctcatcagagaagaggagacatactcaggaaggtcaatgagaagtgtttaatgaagggagcatttacaaaggcttgggctaggttaaggcaaactaatgatgagcaacgaagtactcccacattgataacagcaaggaattgttaccaccctaggcctgaaggggcaagggatggtggggatgggggattatcaaaccctaaaaatgccatagctgtaggaaagggctaccatatagctaccagataagaactatagctttttctaaaataatccagccactgccaatgcacaacctaggatggaagctttcaagagggtaatttcccaacctcatcctccttctacccaccaattttttgcaggtgtctcacacaagttgaccttgactaaacgcccaagaatgcttaaatgaaacaaatcatataagtcagccttcctgggtgcacagcaggtgggaaaggggatctcaagaagtaaatgaataggctccttaacaggtatccctaccttcgggcttccttccttccagccaaccattaaatggctaccaggatgaaatttctaacttgtcaaactgaccatataattccattgctcaaaaccctccaatgttttctactatccctcataataaaacctaatttattgaaccagacacacaaggcccttcctggcctgttatgtgcatttctccccagtctgatctcttcctatgcctttccttgcacttaaatattaattctcaccagatatttatataacgtaccacatatactatgtgtttttcctaatttaatatgttgtgctcctccatgctttcataaggaggaatattgcatgctgcataagatcacagggtctggagaccaactgcttgaatttgcatcccaggtcccatgtgttcaacctgtgtgtttttgggcaagctcttcgcttcttcatgcctcagttcccccatctaccaaatgaggataataacagcacctgcctcacagggtcgtttttagaatcaaatgagataatacaaacaaattagctgttaggttggtcttgatacttagacagcactccacagttacatttgttatatattacttcatatacatagttatagtatcctcttttactactgtcttggtgtgtgtatatatatatgtgtatatatatatatatatatatgtgcatatgtatgtgtgtgtgtgtgtgtgtgtgtgtgtgtgtatatatatatatcttaaaatagtctatacagctgacttcccttattggatcctagtgcagggacatgtcagaattatttgtgtagcctggtgcctggtacagtggctgaactgaataggggctccataaatgttctgtatgtttaattgagccgtcccatatttgaagtcagatgagtgtttccagaggacagagagaagagacagcaacttggggtgtcaataatggctggattcccatacagcaactctacagaaatttacctaacatcctggagcatgcacatgaaaagaaagaaatgttaattttcaaggagcttatattttcatgaagtgagataggggaagttcatatagaaaatggactctgttatgattctgtttagacatgagtatgtgtataaacagctggaaaaaaaatacactggaccacgaagaatggcactcactaaatagtgggatcagaggtgattttaatcatattctcattcacttttctctacgttttttatactgactatattttacctctgtagcagatgcaaatactcactttaaagattcatttagtcaaccaacctcttctgagagctggcattgtgggactctgtcctcaggagcttagtccaaggggctgagaaaagacatgctataaatagctataaagcaaagtagaaagcttagaggaaaggagattacttctggctggatctaaaaactcttcatggaggagtctcaaagaattggcaagatttcaacaaatggctgtgtggcaagagggcacttcagatggagaattggcacaagggaaggaaggcaagaaggtcacaaatgtacaaagggatacagtggggggaaccggtataaaacgcagaagccaccattatagagagaggctgggggttaccaactcttgcccatggagcatcacctagcagaataatacaagtgccaggtcccacttggggctcctttatgcaatcagaccaagcccgagctcagaggttaataaagctctccatatatcatgaattaagatgacaaggtggatggactgatgggtgaatgggtgaatggatggaccacagtcattctgacttaattaaacagcctgggttagtgaagagaatactaaattttgagtcagaagcttatatttttgtgatccctctacagcacctgactggtatcctggagcacaaattacagagcctctatgattttctttacttgtaaaatgggggtcacagtctggcctacttacatcacatctaatgtagaactgagagaaaataaggccatacatagcaacatgcttggaaatctgcaaagttttacagttagtactgaaagcaaatgcaatcatccaacgacatacttcatccatcaatataccttccaataattatctactgactatctgaaatgtgccaggcacagtgctaggtcctaaggatagattggaggaaaagatcaatttgactactatcctcacagactttccagtttagtctggatattcctttgttccctctaagcagcagcaagcatttccccttgcttcagttttttcagtcatccacccatttaatcattaattcatagtagaaggcgatgcctgtctaggacattacagtcttcattatttagcatgctgcaggtgtgcaataaatatttgtcaaatcaatgtatcactaaatgtacattttctgagtttcttgtcttcaagaaagtcacaatctaggagagcagaaaaaggaaagtcagcaaagatgataagtgtgtggtaatgaccacaagataggaggtacagcttgttacaggaacacacgtgagaggtcagttaatgctcctcatttatcaggagattggacagggcaagcagggagagtctataatctggacatttcataattctaagagatcctgatgtcaggccaggttaaatgcccacaggataatgccaatggtatgctaggtttgggaggtcacccgtggggacagaaggtggagaagtggcaggggccacaacatggccaaagccctctggcagcagctggagaacagactcaagctcttctggaaagaatggtactcttcaaatagtgggattagagtctccagactccagaggtgccttagactcctcctccccaaccccagctgtcagcgctcatctctgcctctgcctccaatctgcccattaccacctcctttgggaactgcatcttttacatgaaactgttttcccaagccactcagtgaagataaataatacagttatacccagttaaataagggaggggaagagaagaattaagagctattggcaagggagaaaagcatatcgtttcagattagatttggaaatagatagagggttgctggaattgattctcattactcctagttattctctcccgtaccatttccctctctccttgctgtatttctttgcttggtctttgtcatttcgcttcatgatatgcccttggtttctatgtttgcatgctctctctgtctctctttttaaaaacacagcccaatgtcaatgagtttttctacttcttcttctcctcttccttgtcccacaacattgcaaactgatgcagagagtgggtgactaaagaatggagacaggaactaacctttgctaacacctacttacgtgccaggctaagggctttcattcattgtcgcatttagccctcataggaaacccacataggtaaagtagatagtagaacaccgagttttcagctgagatgtctgaggccctaaaaggggactacacttttccaaaccctgattcacagattccaaattcagtgttttcaccactgtcctacataggctgagaaaggagcttgcatatttgagtaaagagatcgaggaatcaagtgtatgccaggaggtgtgatatgataagtaccagggcagtaggcatccttccaggtcactcaggtgctctgcctatccatttcatcatagtaaagtcctttgtttcctctgtttttaagatgcaaatatctcctgggaaagaggtatatgaagcattctgtcttacggtgaatgagtttttaagatcactttgctccttcctatatttcactgggttgacctttaacaaattaagttcacctctctgagcctcactggcctcacatgaaagaatgggaatcataaaatcaatctcttatgatagctgtgagaataacaggagataatgcattggaaggagcctagagcagcatttagcctatggaactccctgtcagttgtctgtcttctcgtcactcttttctatctcaccactgtcaaggcaagaagcacctggttgttttgagaaaagtggtgggggtgggagggggggtgacagtaccaaatataaagaaaaaggaggcagcagtcacagagataaaacttcctactttacttgtaaacagtttccaagacccttccaccttgtccccagtgccccgtaaaccttttaaagttatccctacagcaacgatctggaatcatggaaaattacaacaggaagagagtgtaaagggatagagatcaatgatctatcccacccattttactaatatgttaaataaggaccagagaagagtagcaacttgccttaaatcacacagcatcatgatgcagtgttcttctgatctcattgtttagaagaacaacgagacaaggattcactgagaggagaggcagaacctccttaaatcccaaaagtaatttagcagtatgcgggacaaggagtggtaaaaatcccttataatgccagggccccttccaactctcctgaagatgctgccaagagggcatcttaagtctctgtttctaagtctgacttgtcaaccccaacccccacaccccaacccaggggactcagcatctgaatgccacatgcatggattcagacctgacatgtaaaatgcaatgagtcaggaaagcatggcaccatgcagtgtgatgtgtgaggaggaaaaatgaaacctgtaaaacccagtgaccaaacagagcctagaagaataaacatacttgacattaagtccaacagctatttgcagaaagatgggagaggcaaggcttaaaggaatacctttatatgatgaattaatccccagggtcagacgctggcctaaatccattgcttatgggaatcatatcatggtccactagccccaagcaacattcttacctcttagcctttgttcagaccatgtcacctgcctgaaatgccttaatcttttcttctgcatacatggatgttacccatcattcaaaacccagctgaagtgaccctctaagagcccagttcaaaatgccctctccctctcctgagccctcaactcccctggcaggcttctacttccttccctgacttcacgaacttcacccatccctaattctcatgacttttgctagatcataagagtcttctggaccaggaattgcttttatctcctctgtgtcctttttggtagctcagcaatttttgcaacagcaggagcctgacaaatattgactgatacaagattaaaatagaaacccaagtaaagaggacagcatggtgaaattcctgactccaatttcacagattggaatactgaggtagagtgtgcaggaaggggactcggagagattaagaacgagaagtgggaaggaccaagtaagagctcctcagactaagcacaccttgttttacctgtcccctaccctctccttcacccctgctttatagccccctatgccatctatccaaacggcaccaacctggaccaaatgacatttgatgcagccaaaccaggacaactgagctctcctgtgccttgtctatctctgctctgtcattcctccatgtgcccctgcctttatgctcatagatccatatccttgtttttcactgttctctgtttcactgttttttaccaacctaactcttaatcttcagaactcagatgtaagtagactacacaaacagtcaacagctctcctcctctttacatctaaaccagtgtcatgtgacattgcagatatccctgtcaagaggtgagtctgtttttcctccccttgaatcagagttggctgcaggactttctctagccaatgggaaaatgacgaaagtgacacactcagagatttgaaaagcgtttatgtactggggcttgccccctcttgatgctcctgggatccctgcaattgtcatgtgagattagcttgatggaggcagagagaaggatggcccatctgcctatgctgccccagacaaaacctgctgctaaccacagaatatgtgagagaagccaacctgggtcatcctgctgctagcaaacctgccggctgaccacagatgcaggagagagcccatagagatcagccaagaccatacgaagtgcccaactaagctcagcgtaaataaccagcccatataaataggagcaaatcaattgtcataagccactaagttttggggtgtttgttacacagcaatagctaactggaagatgccgcctcctttatgcagcatcccccctcaccccaccacaagatggggttgggctttcctgctctgtgcgtgtcacgctatatgtaatcattgcttcagttatttcatgcttcacctaccctctcctccccaagtctctgagcttcttaaaactaaaagccttgtctcttttgctgcccactacctccctaacacctagctcagagttggtgcttaatgggcatgtgtagcacagaacaaactgatgttgaaattttgccctaagagggatcctgccgtatttccctcagcccctcctccttctaatcaaagtctctgtggctctgatttgagagtgagtgagtattgattggcttcaacagtactgcttcaggagtgtagtctgcctctatattccttaaataagctccatgcctgttcggtgtgttcacagcagccttgattgtaattcagcctctactccattacccttatttatgacgtggtgctggagcacagagccccaggccgtcagtggaatgattacaggacccttttgacttgcaattccacaccattcagtccaatttaggccggccacagatggtgccctgtggcaaggaaggggtgattacaggatgccaggctgagggtggggaggagggaactaacgaccctcttgattttctctctgcatcagagaaagatgaaaaaatggctaaggttatttaatgtcccttcccaccagaacagtgtgtgcctgaattatgacagatcaagcccctctccgatggggtcagacacgagaagtcctgggaccactgtggggacaccttttaattcagtgcaagatgccagactcctctctgcaggtgacatgacagaatgttgttcccatattgccaggctagcagtaggaaaagtggaattccactcttgtctttgctctgtgacctttggtgaggcattcatttctttgagcctgtcttctcatctgtcaaatgtggggactgatccctcctctgactccttccctaggtcattggaggcagtaaaaggaaaaattcaccagaaagaactttaaatagaatgttccctgtgcaaaagtcatggttatgattaatgccaatcaacctggtggaagatgtctagaaaactgaaaccaagaggctcaacaggaaaggctgaaattccctgctatttttttaaatacatcagctccccaatatagcacagggccaggactcaagctctaaaaccagccacctggattcccacctctgccactctattagttgaataaccttccagaaatcacttaacttctcaaaatctcactttcatcatataaactggtgaaagtagcgtcataataatcactggagcatgaaagccaggaaggcaagcactggtttgtcttagtcatcatgtatcacagtacctagacagtgcctggtaaaatgtaaccacttaatctaaaaataataaaaaggctaacacttattaagtgcttactctgtgcgagtctctgttcttagctgtgtgcacatatctcatttcaaactcctgacattcccatgacttaaggataatgataaagccacaggtaacaatgctgagttactgtgccagcacaagaaccagcacatgtctgtgctcaataatgtctgcagcagtgaatgttgctactactatctcctctgcggtgctacacaaataaattgcttttactccagttaatatagacatcatttgagatcacttgctttgaagcaacagagcctgtctttgattgtaaattcctggaaaaaggaaaagatacatcctttgaatatcctcttcaggccactgtggttacaacctggaatatcctcagggtgtcggactagaaatcaagacatctcaattgtcacacctccctctggctcccaccccacttggttctttccatttccagaatcacagaaactctaaacttagagtagactttgtcaactcagcaaatgtttccagagagcgtttcctgcaccaagccctttgtggaagcttttgggcataattttcctgggtctccacttctcatttagagtcaagaaagctgaaactcagagagaacaggggagttatcccaggttacatagcaagtcagggatagggctggtgagaatccagcctcttgacctcaaggacacgctctctgtactctacctgccagattctgagtagcctccttgctctgccactgatgtgctgtttcacccggggaacgcacttccctttctgaacctcacttttctcacctgtaaaatgggaatagacatggcatcttcagaggctgttcagaggatttactaaagaatgctgttagtaaagatgctttgatctcacactgtcttaatggaaactgtgttatgctatcagaaaacagcgacaactacaccttccagtctacatgataaaccttatacacaagtctcagctctattatttatctgagaataggaactaggagaaggggggcccatctagctggtgtcccatccactcatcccatgcaccttttttgaatgtttttctttaatgaccactgactcagggctgtaactctttccctcataaccaccaccctaattcctatctactatgtgatgtgaaatatactagaaggaacatgttgccagagccaggaggaatgtccttgtgatgggcaggtgtgcctatcacagagggaatcaggctgtttactggcattgggaacattgggagtgaggaccaagttagataaatcatctctagggcgtatatacattcaatcaggctaaatggatcataggtacacaaaaagccatgtttatacaacctaaaaacccctgtgaaaatgttcaaccgggggaacacacccatttatatgtctgttctcttaaagtacaagtgtgctcacaaacacatgtacttccttgtgaatctatgcatctgaatctgacaggaaagcattcatatctcctcctatgcacaaacatatatgttcacatatggctgtttcctcatacgcatgcatgtctgcacagactgatgtgttcatgtatgaatacagacaataatgctacagagtagaaggttttgcatgtaaaacctcacacacacattctataaaactgctccctcctaacactgacatcatgagtatttctgtatgtgtgcacattgatgcattccatgacacacgtaaacttgcatcctcatgtagatatgcacatacgtatgtgaaaactttgacaacacagtgttcacagggatatgtaaggccctcccacatgcatgctcctgtaatgtgctcactaggttcgcccacatatgtacatcatgcatgctccattgtgaatgttcagaccagcatatgtgtgcactggttctttacacaggtaggcacatggccaccttcatgggcagacatatgcatatgtgctcaggcatgcacatgcctgccaaaacaggttttaacccaagggcatacccaagccctcatgtgtgtcctcaaatacatgggtacataaatgacatcaggaaatgtccttctgagcctctgaaatatctctggatctttcttcctagaggccacgttttgcactcaaacagaaagaccaaatcctctcctgcggtctcctgaaagcctgtttcctcttttctggtatgactgacagactgctgtagagcacagaagagcagaacagccttgttctcgaactgtccatccacttaatcctttctgattttgttatgggaaaaaaatttccactgatttgctattttatcccctcagcctggtgtccttgaaagagagagatactgacacatggcagaaaaaggtcctctgattcccagctccaggcggcccagtgaccttcctctgggactctggcttccacacaccatgcaggaaacctggccaggaagccaaagctgatgtcctggatgctggggcaaaatcaatcaatcaatcaatcaatcaatcaatcaatcaaacaaacaaaaaggagaaataatgcattaatactccttcactttccatacagccagacattatgcttatcaatgttgcacactgcaattcatgctcaacacaccctcgagggacctattagcaagcccattttacagagaaaaaaactgagattcccagaggtgaaggcactattctaaggcactaaatgcagttagtatggagcacatctgcttgcctcaaagcattttaaaaactcaggagaatctggaaggaagcaggatgtgttactactgcctggcctctggaatcctcctcatttcaagtgcactttcaggagtttcactccctggaagaggccaagtgcactgcagagtcatttttccaggctgatcaaggaacagggacctggataagaagagaaagtttggggaacaaaaggagaaatagagtaggacaggagaatggacaggattggcaagaggaggagaaaaaggagagggagaggacagctttaaaaggtggtctagttcatctacctttaaaaaaaaaaataacaaacactgagccccttctctgtgctggacttcataggagatgctggcagtgaggggacagaacaggatttttcatccatgaaactcctagactagtgcggctaatgcctgttgcatatggcatgtgaaaacttgagtgaactttccaaatcagtgaagaaagagagatgaaaaatgacctccccttccataagtcagcttttaccactatgggcattaattatccatcaagcctattatgcatgttttcctgcataatcctcacaactacctttcaagatggttattatatcacattatatattcatttatgtatgtgtgtatgtacatgtgtatatgtacacacgtttggctcagagaagtgcagacactacatgaaaatcacacagtatttcagcagcagaggtggcattcagactccctcagctgtacttctgggtccttggcctaagccattccttttactgccccttctgccactggctgcatctactacttatggtagctgacacaaaatcagttatttagcctaagacagcagagctagatagaccttaagagagaatctagacttagcaaaactgaggttaaaaaagatgaagtggcttggccaatgtctgaactaggactagaatctagccttctgacccctaagatcaatactgtttgcagaatgcgctttatggcaggccatgcgtttttaagaatgacaactcttcaccctgatattgctgacccagaaggcaggaagatagatgcaggaacagtgatgcctccaagttcttctccaagtgctagagataaagcaaaccttccatccctaaggttataggattagcaatcctaatttacagataagccaactgaggccaagagagggaaagggatttggctacaaaaaagtggggcagccctcctataccaaatctaggaccctttcccatagaattcactctgaacagccctggaagcagctgggtgtagaggattagaagacaagtgtgggaggcaagcagatgggtggttccagaggtacccccttaattgctctggaatcttgtgaggtcacatagggcctagcatttagaaaggtcccatgctgagtttaaggctctgctgtcaccatcttgaaattacaagcaaaggcccccacgttttcattttgcactgggccctgcaaattatgtagctggtcctgtctttgacacttttcctttctgagcctgtttcttcatctctggaatggggtaaataatggggtaacttgacagggtgtgcagccaatactgtcttcccttctctgagccaaacatatatgtatgtgtgtacacatatacacaaatacatacatgcaaacatgcatcaatatataacaggtttgagagggcggcatcactttttctcagtcaaacacctttccctcacttgtcctcagttaacttacctgtaaaataggtttgctaatcctatagccccaggggtggaaggcttactttctctctcgcactaagagaagatcttggaggcatctctgttcctgcatctatcttcctgccttccaggccagcaatatcagagtcagaatttgtcattcttgaggtctttcccacctcttccttggcgctcgtctttctagtacagtgtagtaaagcattctcctgaagacacctgaagtccctgctttcctagtcctcatgcagggcaggccagaaatgtcatggagttttaagtcttccacctatcttcaccccaaccaagagcagcccttagccaaggacagatgggaggtggaggataaatgccctagtgtgggataattcctgggcacggttttgttgttgttattgtttgtttgttttttgagatagcgtctcctgctctgttgtccaggctggagtgcagtggtatgatcacgactcactgcagcctggacctcctaggctcaaacaatcctcgcacctcagccacctaaggactacaagcacgcgccaccacacccagataatgttttattttttgtagtgatggagtctcactatgttgcctaggctggtcttgaattactgggctcaagcaatcttcccgccttggtttcccaaattgcttacaggcatgagccactgtactctgccatttggacatgttctatcctgtcttccagaggtctccaatgagattgaaccccagttgcccacagcagtccttgatcaattatatgcccttcattggctccccttcctgcctgtctctcttcccctactggggctccctgggaccacctccaaaagaaattacttgcattcatctcctcagcctagggtctgcttctggagaactcaatttaagacagggctgctccaagcttaattgagataatgcatataaagtgcttagtactgcatcaggcatagaggcaagccctcaataaatggtaggcttacagaaaaaaaaaaaaaaaaagctactttacgagaagacatgaggaagatgacagaacgtttataattgatttctaaatttatcctcctaatgaaatcatctccggcagaccctgttagtgaccggtctggaatgattttcagagccctgtttcccaccagaggcacataccagttattctggctcctaggacccagcccaaagtgaaagctcatgagattgccatccactctttttctggccttcacaccaagtgagaagggagcatagcccatccagaatctcagagcctcagcatcagagtctcatctatcgaaccctttgttttacagatgcagaaagtgaggagcagaataaacccaaagtcactcagtatgtaagatcaagctcagaagaagaaatcaggcagcctgccattcactctccaaaaaaaacctctttattgactgatatattcattctttttaattgtcccacacacacagagatacacactagaaagtaagccccacagatataaggggttttgcctcttttgttcactgctgtgccctgcctagaatagtacgtggcccacagtagatgctcatgaatgttcgtgaagtgaacaaataatttttccatgacacccatagtctatccctgttgaagctcttcctaatttgcctcaggaagaacaagtccaaaggaatcagagcccaccccccattatgaccagaatagcatggttagaggaagctccagagctccaccaccaatgtgaaccccagctccaaaagtaagtccccaaaaggccttagtcaagttaccattccctccccatcttgcaatagtttactgtatttatcaaaggaggtaccccatatgtaaaacactaaagcactagacacatatcagctattactaaggtagaaagaaatgcccttcttccccccagagacttctctcttgttgctaatatattcaggaaaatttttccaaagagtgggaaaatgcacctatgctggttaagaggatgactaacatgtaggctattttcatcaaagtaataaatagagaatcacaaaataaaaacgttacatcctctccagtccctttcagttttttgttaaccaccaggaggtggttaggtgctacaaggtctttaacaagccagagaaagcaggcttcaggctcaaatcccaggcggactgttagtctcaactggctagagtgtcaaggaattgctttgctttcaccggacttgtttttatagtagccttctaattttagtaagtgatattagttttccaatcatcattatgctattgaagtttccatttacaatacagatattactttagaaaaattaaaaatcagaagcaaaagacagaatgcagacatggtcaaaatgataaggatggccctgaaatgcctgaggtttgggattctctggtctagtcttggttcttaagtcatcaggacaaaaactcagggtccagggctccatatcagctctgccattcacttctgctccgtaactttgaacacaaccattcccctccctgggcctcagcccctaacctttgaaatgaaaggatcagatgtctaaggctccataaggcctttccattttggaaacattttgaatccttttaggaaaccaacaaaaccgtaaaaaaaacccatggaaaatgcatcaaggccatgtgggtgcccctgcctgtctcagtgatatctcactcccaaatgaaaatttgcaaaccccagagtcttgttgacacccatttgtttatttacacggcttcactttttatgtggctttccttctttctgcctaatgcttgacaaaggaaataatgccagaatttaggaacccacgttcagaatcctcactcattagagcacttaaggtgttcacacgtaacaccagggtggcaatctcaatctcctctgccctcactacctgcactagagtcccctgtgcagtgtttgatggaaagagccttgaggagggcacacaggtgcttctgacagattctcaggaaagtcaaaacctgggctttggttctgacctggctcttccgtttggattttatcatatttactaagctccagttccaaggcagccagagacagggaggagtcagacaaggtcttctgctgctcaatggggcctcagggtggtcaggtggacattcagctcatcacatgcactcaaggcagcctgagaagtgcagtcccagagacaggaacatgacagagaggtggcgcaaagaagaagatgcttaatgatgccttaagaagcaaccataggcagtttcctgggcagatgaggactatgtgcaatcatgaagaatggacaggtgtttaccaagtgaagtggggaaaagcttttcaggcacaagttgaggatatacaagacattgagtgccactgattgataaatgggggccaaagtcaccaaactccccaagccaggagcctccagaaccagccagttagacacttggaaaggactcacatggtaagacacagagttttcatgtgaatagatggtttaggacacagtcctgcatgtgcaaggaggagcagaatttcactgcctcaaggaaaattgaaaaagctatagaaagccttgaaaaccagactcaaccagacctttctttctcaaccttctaaattgtatctgaatttctcctttatccctttgtactttgacacttacctccatgcttcctaaactctccttcccacttctcccttcctaaaaattccctccttgttttgtgcaaaacaaaagcattatgtatcttttccctaactaacaggcagaagcttttaacagatttctaatgcactgctagatgattccttaaggcttaaatccccaaagacaccttgctgaaaaagatagagacatctgtagttactggtgctttgcatttgattgttttcataaaacactgctaacaatgcatccgtttcactcacaggtagacacacacagagttaacctccccacccccaccatgaatgtttgcatgaagtgacatatagatgggaagtcttattcatgctgaacaagcagcatcctgggaggaaaagggtctgcattagcaatgaagacacagggttcagacagtgagtgctcttggccaaacctggaggaacacttccgaaagcaagttcacttctcttgtgccaagatctaaatatagcccacccccccaatttaaaatatgagccaaggacctgtggccctgcggttgctgtcttagctgctggattttctcaatataccccctacccagatctaaaccaagtagggttatatattatcatattatattatattatatatcataaaacacatattatcatatattttatattgtattaatttattttataatatacaatatataattataattattatataaaatatgtataattatatatgatatgtttttataatttttatggtatatttattatattatataatcacatataattatatgtcatatagtaatgtaatataattatatgtagtattatatgtaacatacaactatatataaattatataatatactatatattttatataactatataattataattataatcatataagtatacgtaatattataaatatatatgtacaactatttatataaatatatttttattatattgtaaatctagcatgatatattaatatgtaatataatatacacataacataatattggtatgatgaaatatatgcaatatataataatatattacttaatatatataaatatataataactaattccttcaaggcatattcatgacagtaataccaaatgcttactccaacatacctggagatgttttctatcaaaatctcctgaatttagcacctctagccttgctaaaactataagtgattacacctccctaaatgacctaaagcacttccagatgtttcatgaactttaaaatattatacaaggtatttttctcctcttttctctatttcaaggaacaagcacagtggtgtttaagaaggtcttatgtaattctcagcaatgacacagccgtgcctattttccagtttcctttaagaatcacaattagaggcactgcctgcgcactcagctgagttgttagaacagtgaaggtgcactgctttgccagccctctcccagccgccaaccatgtgagtttaaagccagcctggatcatgatcaaggtaatccaactaggcttcttaccagacctgagaacttggacaaatcactggcactgtcccaggctgtttcctcatttatgaaatgggagtaagaacaccttctcagccagggctgctgtgatgtatgcatattctgacatacagcagttctcagtaaatgctcatctcctttttctttcttcaaaatgttgtgcaattggttttctttggacccatgagcagaacttttcattatgttgagtttcagttccttaaattcagcccatcatagaatgggtcagctctccctgattctcgttgagattcatgtttgcctgaaggtctttttaatttaaagtgggagcactccacaataagaagtgaaaaagaaatccaatattaagtatttggacattgaagaacttcagagagtaaaacctccaggcacataagtataggctcccctgactacacaaaattgtgggcagatggtagtcataataggcaacgtctattgactgctcgccatgtgccaagcactcttctaagttatctgaatgagctatctcatgtaaccttcacaatactaggaggtagatactcatattaagcccatcttgcagatgaaaaaactaaagtgctcgaagatttgacaacccatcacaaattgcatggcttagactcaaacactccactttctcgctctccagcccatgcaattaaccactcctctgcaatagcttccctgattatgggcttctggaatcaggcagcattgtgatgtgtgctggcttcaacacagatgacctgagtaccttctagtaagtcagctcctggtctgtgcctggggatatctcactaataaactgaggataattaaatctcacttgcaggacagtgttgagaattggaggtggggtgagcggtgggagagggagagaatgaatgacagatggatggagggagggagagataaagaattgtatgttgggttctcactaaatggtagtttcttcactctctccctcatgagagcctcccagggtggggagcgatggaaggggtcatgtgacggctcatcgacattggtgtcttgaccatggtactatatataagtgaccatgaaggagctagaagctctgccctagaggaatgtgggaagatgctcaatctgctggtatgcactctggctgaggacatcactccctcagaattgtgtttctgcctccattgaatgaccggaacactctaactccttaaaatcagcacaatgctgggcctccccatttcaggtttccatatgggcctcatagggagaagaataaaccacaaactgctatgggggcgtgagcagtttcctgacatccagacagcttatagatatctcgcagatgttgccttgggcctggggatcctttggtctgggcccaacgaaggtcagaagttgtccaagaaagatgcagtgaggctgaatggagaccagaaggaaacacactgggtgtatctgggcctcaggtatataaatggagagccctctggctctgtttaattctctctgcttctcttatctttttgcctctcccctttgtgactgctttcttatttcttctgctgttccttctgttttccctctactttccctcccctatctgctgccactctcctcactctctctctctctgtgtatgtctctctctcatacacacatgcacacacacataaacacacacagagaatcccattttcctcaggaggctgaaatggaacagatttggagccttttatgttgaatagctttgcacttcctgaaggtatttcagagcctcaggaagcctcccaatgcctctgcctccttccgtgtttctcatcagctcaccataagtcccagtggtcatctgtagacccctcaaatgacaggactaaaatggaacttaggggtggccctatctagatattattctgtgctgagtcagcagagcccgacaatgcctgggaaggaagtagcagctgcttggtgcagatttgttgaatgaatacactaatgaatgtaagttcttgactccattttgcaggtaggataactggttccaagatagctaagtctcctgcccatagttagttaatggcagaactagggttttaactcacatctccagatacccggctcattccccaatccctatgatatcaagagtgtcaagcccagggctctttttaaagatgctttaagtgcccctgggagtctgtagattctcctgggaggaaccacacttccatccatcaccagccattgacatcaaagaagagactggctcatgagaaccccaggaaaaactgatgagaggatgccccagagagcccagccctctacacagtgcactcacaggtcagtgcactggcaggtccctgactcccttagtgccagctcttatctgtccactccagagaggggctgtgacccaggacagagagctggcaggactgagatgcctaaggtggtcacacacctggtcagaggagctgggaactcagcaagggtatcagatccaagagatccaagggtatcagccctttcccctttggagctcatccttctttcttttgaactcctgttgaaaccacagtgggatgcaggcagaatgaaactgtaggacaagttgcatcatattcatgagtgaagcagcatagcacagagataaaggtgtgctttctggagccagcctgactaggttcaaatcccacctctgctactcatgaatttgggtgcctttagaaagttgcttgtgttctctatgcctcagtgtttctatctgtaatatggggacactgataatgtccatccttatcactaagttttgtgaggacagcacttaaaaacttgcctggcagaaaaatcaacatttaaaaaatgttaggtattatggtcattattatggtgcatctgaatccaacatgaccacagcgatcttagagtttgggctactacaaattctgtggggttcccatccaggcttggttaatcttaggcttttcttcttcctggcttggaggagagagacacctgtgagagttatcagatgttgaagagcctctggtaccagggaggccaggaatttcaacatcgaggttaatttagtcatgctgtacactctgaagaataagccacacctttcctgtttgcccagcttgacactctcacagtcagactcaaggtacaaatgagctgacctggccaccaaatatgaagccagaggggctttagaatgaacacatccaatgtcctctgtctgtgaaggaaaatcgagggctcaagcaggtacacgtctcagtcccatgcctgagcaatcagctgctgcttctcccacatggtactcccttgcaaaaggcctggagctgcccaggttctgagatcttattgttataaggcacttcatgaaaataaagtactcctaaaggaccaagaggtgctggttcagccgctcctctgagctggggaagcgggggcgagtttcaactagtcactgcgggaggcaaattaaggcccatttgttttctacagggcacctcttggaaaattgcttcttctgaggactcctgggaaaaattccttctcttccaaaggtgaacaattttctccaaaagaaccatttattccgataagattgaagtaatcattaaaggctgtgctcctctttgtatggatgagcttttttttattaaatatgtagtgaggccccataatgggttgttttatgcagatctatagtctcaccttccatgtgacaatctaatactcaatgaatgctcacctctattttagtccaattcttcctcccagcagcacagtgggacacttagcatagtagaaataatagtaataaaacctgggttctaccacttaataattgtatgaattcaggaaagtcattttacttgactcaactgtaaaatggggataacaaattcatcccagtctacttcacaaggcattaatattatttttctttttttgagacagcatctcactctattgcccaggctggagtgcattggtgcaatcttggttccctgcaacctccaccgcccagttcaggcaattctcatgcctcagcctccagagtagctaggattacagtcacatgccatcatgcccagcaatttttttttttttttttaatgtagagattggaggatttcgccatgttggccaggctggtctcaaactcctggcctcaagtgatccacctgccttggcctcccaacatgctgggattacaggcattagccaccctacctggccttcacagggcattattaaggctcaatgaggtatttgagtttcctccctgtcagcaagaccccattagacacaacaaaaaatgaggccaagagatctgcacatgaaggcggtaattcccaaaacccatcaagacatttagtgggagacataggctgcccagttcccaaccccttaatttctctactgcaccacaggtttaagtcaacaacatcagaattgattcactgaaagtggattcaagtagaatttcttttaaatgaactttatggttcttttgcctcctccaaaaaatgaggacagtgatgatacctacttcacagggtagcaaagtcaaattaaacaaggaagtgaactagttttgtcagtagtgaggagaggcattgatcttagagattattattatttcccctgtttgagcacagagaaaactgaggcttagcagcagtaaggatgactgggatgctcaccgaaatacagatctcaaggcccacaatgaaatgaaacacataactgaaataaaatacagaactgaactgaactgaaatgaaatacagaactcaggaatctggcagaagcccaggattctgcatttattcagcttctgtctgggttgactttatgcaatactcaagtttgaaaatcctcaaacaagactgtcttgcatggctcttttcacataaaacagctcaccacaggccagggcttttccatataggattatatttgctgcttagaatcatactgaggggtaaggattactatactgtcacaacctatgaggaaataggttcagagaggttaagtaactttccaaaagtcacagagttgaacttcatatcccaagttggtctaactttaaagtctgtattgactccataacatgactctgcccctccttagtgactagaaccaccactttgtgcctcctttcaaggcactctggggagcattcacggactctgagcagcactgtcacatgtgctaattgcctctctcatagccctttgatttccttacctacagtcaggtgatccttcctcaaccccaaactccccgtaactgccacccccacctgatcatgctgcatagccaatcagaagaacagcactgatttccactttgcatcccagcctgggacaaatgtgatggcacagatcaaaggaagtcttggaattaaaatgtgaaacctgcagaggcatcttggggtgatggacagcctgatgttctggtgtgctgcttgcttgtgcacattctagatgtgtaaaaatgcccatctcctccacaactctgtcaagcaaggacacacaatgtgccccatcagttttttttcacacagtgttgtccactacagaccaaaaccaaacttctagcccaggtggtgagagaaacacgcctgcctaaattcataggaaggcaaccatgaggtccaacactttgaacagtggctgtcatacagcgggtgcttagtgaatatctgtggatgcagtagaagaatcaggcaggtctgcaggaaattatgcagtggcatgcctagatcagtaccaggttgagagcagatactcaacaaaatatttttgtctccagaaaaccataaatctttctggctgcagggatcagtctcagatttcagggcctctctctggccttcccaaccttctctctaaacaaaccagttccaaaatgttatagactcctatccaaagctgtgtgccccactcccaccattctttgctaaacaactgaataatgtcatgaataaattcaggctaaggtatacatagctcctagtaaaaaattcagaggaatggaatcaagttataaacaccatgaaagttcactgtcatgcatctccaactccaagacaggaggggtcaccatggtgacaaaactagcggatatttgggcaaggagtggggatgttctgtgattcatcttaaaccaaataggtaaccaccttctctgccaggccaggttctgatgctctagaacagagcttctcaacattggaactattcacattttaagccagataattatttgaggtgggcgctatcttgtgcattgtagggatgttgagcagcctccctggcctctactcattagacaccagtagcattccctgctccaccagttgtgacaaccaaaactggctccaaatatggtcaaatgtcctttaggagaaaaatcacctcctgttgagaactactgctgtaaagagaaaatgatgaaaatttactaatccaattaatacaaagcaaattctttaaaaaagccatggtgtctttcaccactctagcctgtgtattctggtccctctgtttggaatcttctccctccctccctccccatcttatccccgggcaagcctttattgctccataattcagggatcacttctttgcaaagctttctagaatgtcctatgatgggataggagatagacccctcctctgtttgacagcaagttgtactcccccttatcacattatggttatccctctgcactcttgaacaaaactgcacattttgaggggaaggtctcttcttcattcattttcaaattctagttcttaacaccgtgccctagcactgaataaatacgtgtatgaacagaaggctaacacttaatgatcacctgccatgtgtcagtcctactgtgtatatcctatcttggtatgtctttatgttaatgttgcatcataggctactactattactccacgtttctagggagtaattcgttcccagagagcagagataactcatctaacatcacacaggcagcaaatggcacaactgggcatatggacttaagtctgcatggctgacattctgcctttctgaccttctgtcttcccatttgcatgcttgccatcttgcttcctacagtagccaaagacagagccctctgccttgggcttttaggtcttggggaggtgcaccttgctgcttcctccttaccaggccataaatcctgttgaatctgggcagtgaagtggcaggcaggttggtatgagctttgttgatgtgtatgcctgggcccccagcacaggcacaagttgggctggagacccagggcaatggaagatttctttccacagcagcacagaccaaagcagaggactatgggcattttcaacactctcctgtctctggtggtgttattattttccttcaacctttccagtaatggggaccttcggggctgaaataagaacaataatttttttttccttctactctcctagagtcaagtccagaatttaataaaggtaacaaaaatactacggtattccaattcctctctgcagatttttgttttaatttagttttagccctgatgttagattgacagtcctggggtctgaagtgtatccattcccatagtatgtctggtgcagagacagagtgactcatttttatgtgtgcacacacacacatatacatatacacacagagataccatgaaaagaacaatttctcctacaaaatcagaaaattgtctgcattaaactgatctgtgcacagtctgtctgccccacctctgaccccccaaagcctcattctcaaatataaactggcattccaggcaatcaatcaagacctaacccctcaaagactaccaccaccaccactaccatttgatcctaactgcatttacccaacgtctggaattaacctctttgctccggccttagatagagcctcttcagggaacatggatcttagcttccgaaaggtttatggctttgccagcctgaagacttcccaatatctctggcaatggctttactccagcccccacccttcagaacaccatcccactccctgttcttactctgaatcactgacattggattcattcaaagaggctggaggtgggggcatggaagaggctcaacaagcacaaagaaaccttcagtattataactcaacaatgttttcagtgtgaaatatgtccaggattcaccctccttctaatactaattatttcccacaaggtttcctgttgcaaacattctaatttcttttctttctttatatatatattttttattttagcccttgttgtagctaggcagttattatgacacacatactttgttgatgaggaatgaacactcagagtaaaactgagttaaatctacatctgtgtaactcacttcacttaatcgaccaacaaatatttactgagtgcccaaatatcggctggacaccatgctaaattcaggggacacaatgataaataagacatatgtagtcagtcatgtgccctcctaactaaggagaaagaagtgccaatcagcccatacagtacataatcccatgtgaaaaaaatgcttgatgggacgagcaacaggtggctatggaaggtgaaaaaggaagcccaacccagccacactcatgcaagctcacaggaggccaggacacctatgctgggagctataggatgagtagaattttccagggaaagagaaaggacaaaagtgttccagccaaggtgaacagatatgtgaacataaggaaacaatagatccaaatatggatggtattagtccattctcacactgctataaagatattacgtgagactgggtaatttgtagacaaaggaggtttaattggttcacagttctgcatggctgaagtgacctcaagaaacttacgatcatagcagaaggggaagcaggcaccttcttcacaaggcagcaggagagagaagagtgagtgaaagagggacttgccaaacacttacaaaaccatcatatcctgtgagaactcactatcatgagaacagcatgagggaatggcccccatgatacagtcacctcccactgggtccctcccttgacatgtggggattatggggattacaattcaagatgagatttgggtggggacacagacaaaccatatcatggatccttcaaaaaactagaaaaaaaattatgcaatcccagtacatagatttggggaggcagggagaggccatagcaagtggtgaggctagagagctgggcagaggctgaagcatgccagacctcccaggccatgctaaggatctggaatttctcctgatatccatgggtagccactgcagagatttaaacagtttaaggagggatgagataccttggatagctctctgtctactctaccctcaaaaggaagggatatatctatgggcagtgggagtgaaagggagtgctatggggagaaatttaatgcagaggcagaacttgtctaggcccctaaagctgggaattctgagaggcggtgatgggtctgggacctggcatgctgcatttcaggagcactgaacttgtttcaatgtccaggagaagtgggttgataacagagagtggaatcatccatgtaacatatttattaataaaacaagcagacaagagacgccatctgaagcatagacttttcaccctgagccctgagggagaggctgatgacaggctagactctggccagtccaacacagattctggcctccccttccagatgccacaagacaattctggattatccacatggggatgtctgggccagagtgtacaggctcacctctcagtttctgaccctatagccagatgcagacagttgccctcctcctgtctttttcattgccatgggctcttcaggcagcctctctgatgttcattaaaacagtcagtctggccagtctcaagtctgagctgggcagactgagattgatctcataacaaaggagctggacacctgggcttgaaacccccctctcctccctgaatttggaatctccttttcccctcttccctttccagcagactcctaaatgatgaagagtgtctcatcaattcccccataattacctgctgtgtgtcctcacggagactgataaggaagtaattaggatagacatgcagggattacaggaagggaaaaatgttctgttgtcaagataatgccactttccctcacgccctcccagacaaataactgggcagggtttgaggattgttagagatggagaggctggaaaaggagtgaggtgaacagaggtggaagaagaaagtggaaatatgcatttcagacctgaaggggtccttaataatcatctaatccaggagtcccaaactcaacgctgtcagtccccaggcaggtcatataagtgcttggagcagaagagatggaagaacagccatagtacatgcctgatgacaaatgacaactgacacttggccttagggagttaccctgagggaggggtggggcattctcatccctttcagaagaggccacacagcggagcttcacagcacacattgccatgcaggaaggaagcccagttttggcagctcttctaatttttcaagagaagctggaaatccagctgttgtgtgaaaattctcatttttttctcactttggaaacttctctgttttttttttaatttaacaaaatatgagccaaacaaaatgatatctgcatgccagatgtggactgtgggcagccagtttgagatctctaattttagtccagtgccttttttatagacatggaaatgaaataagtattcggagaaaaagagggttttgcccaaagtcacagagcatgttaatggcagagtcaagactcaaacaagctttagctccttactctcccatttttcacaatacttaaaactggaggctgagcacagatcataaggaaaaaaaacaggcatataaataataccagtgagtgcaagcagagatatcgaattgcccaaagaaaattctgcagtggaaaatgaaaacatcatttcccatggtagttgtgggagaagggagaagaatgtacaaaaggcttaatacacaagggactaaaccatttcttgctttgatagaagaatcaggagcacccacttctgtattagaggattgaaattggggatacgaacacagtcccgacccactaagcagctaggaaactgatatgtggaaaggcagacccataaatcagtatgggtgatgaagtgttccaagtgccaagagagagtatcttcaagaaattagggtgagccaagataaaagagtgctgaatctatatggaagtgatggtgataagtaagtcctcaaagacaaaatgacacttgatatggaatttgaaggataaacattttaccagttaatggagcagtggatataagttaaatcctcaaggacgtagagcaatggtccccaacctttttggcactaggtacctgtttcatgaaagacaatttttccacagaccaggggagttgtgggggactggttttgggataaaactgctccacctcatatcatcagacattagagtctcatgaagagcatgcaacctagaaccctcaagtatgcagttcacaatagggttcgtgctcctatgcatatctaatgccatggctgatctgacaggagatggagctcaggtggtaattgctcgctgcccactgctcacctcctgctgtgccatctggttcccaccaggccatggactggtactggtctgtggcccagggattggggactcccaacaccgacaattgagacatttgaggacaccctaattacttccttatcagtccccatgacaacctacagcagcacctggaggggatggactccaggcagtgagagcagataagcaacagtcccatggtagaaatgcatggaagtatataaagcaggacagtgggggttacagtagatagggtttatgttcaaggaggtagccattggaggcaggctgaagaggagagttgagaccacatctgagaaggtcaagtgtgccaagcaaggaagtgtgcatatgttaagtaaaaaatgggcagctgctgaaagtttgtgagcaggaaagggagatcatgacagtactggtgtgtctggggaagattcacctggcagtacataaagaagcttgaatagcagcttgaagaaaccgatgcagaagtccctagggaggttgtgaagagctcccttatcctccctccttcaacaaatatttgcaataagacactgcaacaagcatcatgttacaagcattatgctagaagcttgggatccagtgataaataaagcaatcattcaacagatttatttcacacatagtatgtcccaggtactctttgacggcagggttttggcctcaatcatttcagagccaacaacagagtttggcgtctagtaagtgctcaataactgtttgttctatctaattttcatgaaaaagcccaaagggaaagttaaaggaccgagcttgggaaatttcagtagagctcaaaggcatggataggagagaagagggctgtggaatgaaaagatttctgattcttagatcaggattctgagtttcattctcgagtccttgcaattgttctataaccctgaacaattccctttctcggactcggggtcagtttctgcatctgcaaactcagggaacttggagtagttcccgaaggtcatccatgaaattgaaagcatgatcagatgggataggttgcacgcatacacactaaacatgatcaaatgggataaattagcacagaggaagatagtatagaatgtgcagaatctctcagcctaggaggatagaataccaagaagagaaaaaaagacagaaagaaagaaaagtaagatttgagaaactttgggactgttcagagctgctgagctgagtatctgtaaacctcttgaatcatctctctgccatgacctgccccctgaaagacctcaggctgaatgatcccttctgtgtcctgccactttcattattataattactgagtccattggtattctctagatatgctatatgcggtggaaaagcactttcccaatgattgttaattaatccctcaccactcctatgcctgagagggactgcttagtggcctcatttttcatcccagggaaatgggcacagaaaggggttgaaggttgacagggtcactcagccaggctaaagctgaatcaggactagaacatggggcctttctctagccattcatcagctgccccatggatgacccagccagagtgccacagagtaaatgggtttagcaacaggtcgctgtgagaagtgatggcaaatcccctatagagtgggtgacggagagccatctcatggcgaggaaaagaagagtggagtggatgccctgtggaggttaaagggaaaggaagatgaattaaggtttggatgccatcgaaggagtctgaactttataaggaaagcctggacttctactgggattcagagaaggaaaatgtggcctcttgctgtagaagcaaagtgaccttctgtcaggttaacctgcagctggagggccaaggaagtgtgacattccccaacaggtcagggaagacttctaggaagcagctgttgcaccttcttccaggccaagcaggtaacctactgcacttccaagttctttttttttttttttttttttttttactttttgaaatttttattataagcatttgctaccctttaaaataattgaaacaagattttttttgaaaacacaggtatgaggtagataccattccttgttccttgtccactttcctcttttaatgtagagatcaagttttggccagtgatatgtgaacagaagggaaagctcattgtccctccagtgctgacacaagaaagcctgaataataatgtagacaggaaaggaaagagggagaggagagggagaggagagggaatggtccctcccttgaaggtagagactaagttcactttttcacatggattcaggggccctggcactggtgggtgaagatgaattaggattgggttttagaggaaggggagaggaaactctgctattcttagtcaaccaaatgacaaaggggggtggacatgcagtggaggtgagaggagaaaccagatgcaattccttctccaagatcacttggcaagaagttctagctctcaggactccatataaagtggccatactcagttgctgctggggtcataaattcagagcccagaaaagatagacgactgtgatgaaaatagctaccatttattgtttactatgttccaggaactgggcttgacactaaaataataatagacatgactgccattgctaagcacacattctcctaggagttgtgcttggcacttctcatgcactctcccttttaattctcaaactgccccatgaaatgggaactgttatcgttcttattttcccatgaagaaactaggactgagagaggttaagtagtttagccaaggtcaccagtaactggcaaagcatggactcaagcccaggtcttagtgactccacagcccttacacttaatccatctgaggacttgcttctctttacccatggttttctccttaataagggaagctgatggggctggagtgcctgaagaagagcctgcccaagtcaacctggatgctcccattataccctcccaccaggacactccagataatgccaaagagggaacaattctcaggcctaactcctgctcattttcacacacttcagcctgaggcttcaagaaacccaactgacacaactagacacagtgaaagagaaattagccagatgttggggatgagtggaaaaacagagcaaagctcttcacctgagtccctctccgaagcccctctctggattggttcctggagggactccctgagcattggtttgtgatctccatgcaaagagcagaagagaatagaggacggcagggctccagggctgaaaggagccaatagctcatgttcctccatcccgacttcaacacttcagcttgaccattggtgtgagaccctgcctccagctcaaataacttttcctcttcgcctcctccccacctaccccttcctctgtgtcattctacatgaacacatgtggagagagagaatgtagcagacacagctcatctttcctccccagctgcaaatgcaatgtaccccttttaacaataataggaaaccccaaattcactgggcaattcccacctttctttgtagctagttgtaaccatgaaactgagtcctgtctaaagggatataaatggaagttagtttaacttgcagaaaattcctgaaatgaaggggatgtgcccttctccggatcttctctcctttccatggctggaatgaggacacattgggtagagctaggataggcctgttggctcatgaagtgaacttgagaattcaggccatgcacaacatagcaacaggcagagggaccctgtgtcctcagcagtgtcctgcagcatgcaacacctaagacagaaacaaacacctacttgtgtaacccacttgggttttccgtcacttttggctgaatcacttctaacacagcaagggggtatttgatagtgaagactctaagtgtcccaatcacagaagtcatatgtcctatgtcttctgtaagttggaggcagagtctcacactgatggtcaagctgaagtgtggaagtcagaatgggggaacctgagctattagctcctttcaggcttagagcccgaggtttcctgccttcctctttcccttctgttctttgcatgaaggtcactaaccaatgcccagtgagtcacccagaaaccaacacagaggggctttggaaagggactcagttgtgtgtgcttccaaacagtagggtttgatagaaagaagggctttggagacagaatatcaattgagcctcggtgttctcatccattaaattgggctccgagggttaaatataacaagccataccctcctgaaggaagggctatgtctgtcttgttcattgacttatctatccaccaatgatacaaaacatgactgacatacagtgctggataaagaattgataaataaatgggtggtgtgcaccaagcacatggcctatggtgggtgctcttggaatattagcgattttcaacacaatcctgacataccttctctatcagaacttttgactctgatagcagcttgtgaagattaaaacaaaagcccatcgaagatttaaaaaccaaaaacgaagtctgtgagttaaatttctgaattccactgcaaaaacacttagggagggagggtctcatctcccttttaaaattggaatgcagaaagataattaccttcctctttctacagccttcttagttcctctctcctcaacaaccctccattcataccccatttaattttcacacatgttcttagatgctaattttctttcagacttcactgggcaggctcctcagcttctgtctgaaaaggacagaacccagaaaactagaaaatgtagggcccactggggagggtgtcagctccccaccaccaaggaaatgtagatttaatacaaaagggaaagaaaggaaatgaatgaattctttttcttcaacttgttttcttttttttgaaaacctactttgcttcataataataataaataataatcagctatcagatatctgctctgtcaggctttagctaaatgtgttgccaccctttatagcataactttcacaacaagcctacaaagtagacaggattggctgggtgtggtggctcatgcctgtaatcccagcactttgggaggccaaggtgagtggatcacttgaggtcaggagttcaagaccagcctggccaacatggtgaaaccctctctccactaaaaatacaaaaattagctgggtatggtggcacacgtgtagtccgagctactcaggaggctgtgtgagaatcgcttgagccagagaggcagagtttgcagtgaaccaagattgcaccactatacttcagcctgggtgacagtgagactccatctcaaacaaacaaacaaacaaacaacaacaacaaaaaggacacaggattagcctatttaacagatgagaaaatgaaggcttgggggcttaagtcacttgcctaaagcaagagctaacacctgctcacatagatgcatacacaaatgtatataaccgtactattcacaatagtcacaaggtggaagctacctaatgtccatcatctaatgaacattcagctcaatatggcatatccatacaatgggatattagttggccttaaaaagctatgaaatacagatgcatgctaaaacatgaatgaaccttgaaaacactatgtttaatgaaagaaaccagtcacaaaatactctgtattatatgattccatttgtgtgatatgtccagaaagtagactagtggttgcttaggggagtgggtagtgctggggagatagggagttgatagttagattatggggtttcttttcacggtgataaaaatgttctaaaattgacaggtgatggttgcatgtatctgtgaatatactaaaatccatcaaattatatactctaaagaggcagattatattgtatgtgaatcatatctcaatcgagctatttctatttaaactgatgcctgaacccatgcctggaaggctcccaactcctgttaattccacctcatcacctgccattgacatgtgccacctcattgaatgttcagaatgattctgtgaggtgtgcatggccgctctcatctcacaaatgaggaaattgagggccagagaggaaaaataatgtgttctcttgcaaaggaaaatttaatttagaggaaaaaaaacctgattttttcaacatctctaatatgaggaaaccacccaggttcattataaagagaaaatgtgagagcagcaacagactctaaaatgatctagccatcttcaaactgcctccaaaacaccataaccaaaagatgcccatgtaggtgctccacagttattgcagggggggttggaacagtttttaaattatattttagatactgggcttccacataagacttcaataaaaatattactaagagagtttggaagccaccgatcttgtccaacttgcccattttattttactttattatgctttttagtagagacggggtttcaccatgttggccaggctggtttcgaactcctgacctcaagtgatctgcccgcttcagcttcccaaagtgctaggattacaggcgtgatccactgcacccgtccatttgcccattttaaacataagataattgaaagaggagagaaacaaggtctctctgagccacatggtgagttaatgtcagcactaggccagggcctgtgtttcactgcttccatgttgtgcactcctcttgtccagattaatggcctggtgcatgaagaataggctgcagaacctggtttcacttccaaaccatgctgcataccagaggtcaacaaacttttctttgtaaagagccagatggcaaacattttgggctttgcagatcatatggttttccacaattaacttggttattatagtaggaaggcagccagagacacataaaaaaggggtgtggctattttccaataaaatcagtagggggctacagttggcctgagagtcatcatttgctgtctccttctccaaacagatcctatactcttctttccagggataaaagggctggcatatgatgagcaaagtggtcactctttagtgcctttgtaggaactgtccatggtggtagtgccgggtggtggaatcaggaagttctgctttcaggtgcaggcttaccttcactgacccctgagactaggatacatcagccacaccttgagacatttatttttaatatgcggaaaacaacattcaccctcagggtcactgtaaggattacatgagaagtggtatatcagggctttttttttttttttgacggtggagagaataatgataagcaaagccaggcatactccttgccttcatctcccagcattctgcctctaccacctggttccagccaaactgccctccctgctaaatgccttttacacaccagccacagtggcttcatagtcctcactccctcttcttggaatgcgtttcctaagagcctcctgtggctcactcttctcatttttcaagttttagcccaattaccacttcctggaagttttcctgatgattatttaaaatagcaacttcagaccaggcatggaggctcacgcctgtaatcctagcactttgggaggccgaggcaggtggatcacctgaagtcagaagtttgagatcatcctggccaacatggtgaaacaccatctctactaaaaatacaaaaaattagccaggcgtggtggcctgtgcctgtaatcccagctacttaggaggctgaggcatgagaatagcttgaacccggtaggcagaggttgcagtgagcatagatcatgctactgcactccagcctgggcaacagagtgagactctgtctcaataaacataaaacaaaataaaataaagtaaaatggcaacttctaccttgcacccccaggggctcactccattgctttattttattcatagcccttaactgctatcttaaattccatcacttgtatatttatttacatgtttattgtcagtttttctttaagctctaaaaggacctttctgcttttctagaatccagaatgctgcctggaacatagtacacatgaataaatgtttgttgaaagaaaaatgaagaaatgatatctccaaattgctatgactttctgaattattttctccaccataagctcctatgtttggcaagtactaggctttaacacaatacaaacatctccatgttaggaagacagtctgatcatatattcctcaattcagtgtagttttacctggaacatagaaaatgtatgatgcaaattatctgagcctctaatgactctgattgtcaagagttggccttgcaactgaattgtaggagggtcatttcattaatttccatagtaagttagatctacagtttaacttcattcttacttatattttgttaatggggaaatcaaggtcccataaaggagaatggattttttcacagtcttgttcttcactgaatgaggaaccccttaaatcaatgaagccataaaatcctagtgccacaggccccttaaaaattaccccatctaataacatagataaagaactcagagcaagaagaaaaaaaaagggacttgctcaagatcacccagcacttcaatggtagatttaggaatgaaatccatatctatgtgtacccagagttggaatctcactactctcccttcatgctgctatttggagaaaaacagaaatggagaaaaggaaatgaaattattccaggcacacatttagcaatgctcataaatcctgacaatattaacaacacacgacagcttcgttgaacaaattggcagtgagtgtaggcagcttaaggagacaggaggtctggaaaggaaaaaaaaaaaaaaaaaaaggaccaccaggcatacacaaaaattttcccattctgctcttttctaagtctgtctgtaaaacaaggcctcagacaggaggtgctggggaatggtaagagtttgaaggaggtgcttgcatggagtgtgagtgtatgtatgagcacactggtgcacagctcccaagagactgtatggggaataatcctttgtaagatgtcactcatcctttatacaaattaacctccacctccctcatgctgggattaatttgctctttgtttccttgacattcagctagggagatctcagaagaattaaagaaagttcttcaagaggtgaaaaggggaagtcagggcttctggggcctggaaccctgaggaatcatcacccgatgcagcgcttccctacagggacaaagagggagatctcttgatccccatctcctatctgcaggaggaagcccacctcagcccccaaatcctggtaagtaagaataatatatcctgtttattctgtgcgtggtctatgcattccgttgagtactttgccagcgccatactaaatttcaccaactcactgccatgaaggttctggctagcctaggttttctgccacattcctgaccttgcctaaaatgtttgattctctagcctccagtcaaatgggttctggtttaaaggaccatccacatgattcctcagacttcccatatggccccacccctttgttctctaccccaaagtttcaggttcatgtcagtctatgtcctcaaaaggtccagcactctcccagaactcgaagctttagccattatgaaaagttctgacacaaagggagaatgtaaaaataaatataaaacaccacaagatacatgctcaaaggtatggctcctccgtttttcctcttagctgtgtatctgtttgctgtcagtttgcatgaataaataagtcacctaacattacttctggaaagaggagcaatataaataaatgcataattaagaataaataatgctaacatcaaattaatgaagaggggttttaaaaatacatgtatgcaaatcacaccttaggtgagaaatctaaaaaatcacacataccctatggtacctctgcatcagtgcaacaaattactatgaaatggggaattcccattttatacatgggtctacagaggccaatggagaaaaaatagtcatgggttaaatggcatattcaaagacaaaattattggattggtcacagggcaatgacctgtgatttctgggttgcagagatcaaaattcctgcacattaaggcctatcctaataaactctgagaagttagaatgcggagaaataaaaagagaggtcatttttaattctttattatctaccatatgtttcaaaagaccaggtatgtgattatgcctggcattggactgggtggttgcaagcattgttcttttcattcttataacagcaccgttaagtaataacactatgtcaggtaagcacagtgaagagtagagaaagaaagcaactttctggaggcaaaataactcttaagtgtattctgtgcatttgtataacttcaatatgtttgaatttttactgctgggattcccttttaatgatgagattaggtaatgaggtatcatggagagaaaagtggggagcttccctttaaataaccaactagtagacactgttttaagtgaaaacactatatggggcacaatgagtgagctcatagccaaggggagaagcagaagcaaacacaactgacctaatatccaaggcatgggggtgggaggccaaggtgctcatgacctcgggcaagccaatagcaggtacaataaattagctcaccttctctcacacagctaagtgaggtaacagatgtgatcatgttttgccatgtacaaagtgctaccaagaatctgtattccatggaattatcaaaatctaattttgtccttattcatataaaaaataaggaatcgatgattatctcgcatttatctatctacaacttcacagtgtttaatacttcctcatcatcctctcatcctcacggacatatggagagaacagaaggattaggaaagattgccattttcttccaatgcatctactagtcttctatgcagcatctgactatttgttaattattattttctactcaaattactattcaggacaactagtgtcctgatccaatctcgtgctcaatataacctcaatggatgtgtctcccccaaccttttaatcccccaaataaagcatgcccacttagcctctatttcttcctagacctgcatctaaaacctcctttcttgaagcatataagcaccttcaatcctacagatcctatccatttatcagttcatccatccattcagccctcctcccatcttcaaatctttccaaaaactttttcagatgccccatcttgtgctgggcacacataagaaaaggtcctttctctaaggagcttagcaattaattggaaaaacagaggatacttaaaacataccctaacacgtagaagaaaacgatcaatcatataagacaaaataggggaaggtgcttcttcccccctccaccctactggcactaatctaccaagctttagctttttaatggctttggtaggcactgaatacgggtggattattgggttggtgcaaaagtaatttttttttttgccattatctttttttttgccattatctttaatagcaaaaaaatgcaataacttttgcaccaacctaatatcttaactttcaggcctggtcatcaaaactcaacagcacacctgtccatgggaactctcttttctacctctccagacctcacagctgtgtgcgtaattttagtcccccagctttgattgctatctctcatcaaccacatgagttaatgcagttatctaggggacaggtagacactaggatgtagactgactgcgggtgatgatgggggagctgtagacctgggctgctgcttgagctgctgtttgatcccagctttccctcagggcaagcagaggtaatgggcacagcaggatttaggcatctgtggttcctgactacaacaccatcaaacccccaattttctctcacaactggtattagtatttcacatctagcccatgaggcaactgaggctcacagagggcaattgactttgttccaggttacacaactatcaagtggcagaatcagggtaggaacttcaatgtgtctaactccacgagcgctctttccactatgccacaccgcattggagctgagatttgaagggtacacatgatctgtgtgccgcagaggcagaaagaggcaaggtcaccctgtcccactttaaaaggtctgctgagatctcacacacatgcacatgcacacacacacagtccgctgctgccacacctccaatgtcatcaggccagctgtctttacaaaagccaaaaaaaaggaactcctttgccaacactccgtttacaaagaataaaaagagagaaacatcatgccttttcctgaagaaactttttctgttaagaagcaagaacccaacagcttccctgagacccatttttcatacgattaatgtcaggcctctcatgtttcctaatgaaacctgacactaactgagaaaaatggatacattaatattgagttcattagtaaatagattacccaaatgtttggggtgaggggaggaagaaggtgaaggaagaaggagaaaggggaagagaagcacacataccactcagctattctggcaagagactctctgaggaccacatgctaatcaaatatttatggattttaatgcaccgatctgttaagccaggaaatagtctcttttacaaaaaaaaaaaaaaaaaatttaaagaggcccacatgataccatagcgttttatttagatgggaactgaggcctgttgaggaaaaggcatggcccagagtgtggccttagttacctggacagggagaacaaatgacagctctcagagacatcagaccctccctgtcctcatcccacacacacctcttcatgtcaacagaaagtgtcatgaagcattcaagaccagcctagccaacctggtgaaacactgtttctactaaaaatacaaaaaaaattagccgagagtggttggtggcatgcacctataatcccagcgactcgggaggctgaggcaggagaatggcttgaactgggaaggcggaggttgtagtgagccaagattgcgccaccgcactccagcctgggtgactgagagagactcagtctcaaaaaaaaaaaaaaaaaaaaaaaaaaaaaagtgtcatggagaggaggaggggtatgactacttcggggaagagatgtagcctggcaggaacaccggttatagaagaaaaatgcccggtgcaccctgctaaatttttctgccacctctaaagaatacatcaagggctcaataataactactctctaccacgctaagacctgtggggggaatgaaggcaaaatggaaacagaagaagcttgttattggagccagtagagcagaagaatctggctcttccccttccttagtgtgagaccttggacagctctcataaaatcactgtcactgagctccagtgaggtcacaggcagaaatgctcttaatgtaaattgtcaagtgccataaaaggcaccatgttgctcttttgacaagatatccccttttctttatgtctatgtgatgaggcacaaagtaagggtgaggaggctaggaccccggtcccagttccaacagtgattcatggtgtgaccttgtgcaatgcccttcctccctctaggcttcagtgtgcccatcagcaacatggccaggcaggaccactactcaataaccatgtggggcctttgcatggtcttgtgcctatgacaaccctgagaaggctctaggaggaggccctgctcttaagcagtgccagcatggtgctggctcctctagggacccaaggttatccttgattacaaggtcaaagtgaagagatatacaggattgaattatctcttacaactattgtagttctcacattttgtgttttttaaagcccttgagcaaggaaatctcatgtcatgctctgaagagaaaacaacttaataaaagtgaggacagaaagaaagaaggaaatagtccaggtagaaatggaccccagagaaagtaaatgttcatgaatcaaatcgttttttttcctggttgctgcatttctctctgtcatgggtactttattcactgagataggaatgatctgccaaagcatttttacacacaagagatggagatacacagacagatggtgagagacatagacagacacagcctctaagctaggggcagaaactttcctgttctttgtgagcaggaggttaagaaaacaaaaagaaggagaaagggataataataattttttgaaaaatcataaagtagcaaacgatcaagcaaaagacaatgccagattcaaagaaggatctttgtattccaaacagcagtgacatttccttaaacagcaaagtggatccttttatctgggtctttttatgggccttttgccaccagatttatcagcagagagagaaaagcatgaaaaggaaagtgtaaagtgcataggaggatacaaagcaggaaacaaaaatgcatttttcccccaaatcttctaatgagactcactagctctattgtgacaaagtgagaggtctctgtggagttcatttcacatctcatccatcctcagagtaatgggaaaatcctgccttgtttctgcaaaataccagcacacactgtgtgccatatacactcaattccattagaggtaatggaagaagattgttccagaagttgttttcaattgcttgagtgcacccttcatttagggaaacaagaatatatgagctgtttgactcaaattgaagtatggacccaactttgcagctatagctatggttattctcttctggatgcctaggtgaggacctggtcaaatatcacctctccccatggttgaagagataatatttagcatctccatttcatgtcatgtattacaaagcagcacacagctattcattaactgttgttaacggaactcaggtccccgaacaaaggcatcctgggtctgtgaataggacaatcaggttcagagacaggagaacccacatgctaaaatgccagatggttgggagcttgaatcccccattctgccacttctagatgctttactgttggcatgccacttagcctcactgaaactcagttttatcagctgaaaaatgaaacaaaaataatacatgtttgttcgaataattcaatttatgtggcaaggctggtgaaaagtctgttagaaatcatatagaacttgggaaatgctaatgagcagcagtgaatcggagtttcccaaagtgagtcctgcctctgaaccatcctcttctttgtgtgattttgtgaatttagaaggtcaggttttcagagtagcccagggatcgtttggtactgccactaataaactaggaacatttggtcatttgtttcctctggctaggtcctggtttcctcacctacaaggtcctggcttcttcacctacaaaatgaggggagactgacttaacacgcaatattaccattttcaaactgtgttttcagaacagaattgtttcttccaacacggttttatatagaagaaatagaatatccataacaaataagaatgggttaacaaataacaatgcggaccaggaaccctgcatatttccatgtccctgatgaccttcagtggcatctcttctggggaagccaagggtactgtggcatactttgagtcttgacaacattgagtcgccatcaaatgacattctgggaggccacagaccagaagtcccatgggaatttcaggagcttggtgggttggatagctttttcctgattggcttccaaagttaggcaaggggaatagttcccccctcactgcatctcacactcacttcagaaaaactaaagtaggaagagtcagaagtctaacatcagtttaactggccaaaatcaaagtatgtgcagggctgcaatttctctagaggctctaggggagaaactattccttgccttttccagcttctgctagctttccttggcttgtggctgcatctgttcaatctctacctttctgaatgtgccatcacctcttctgtctgaagtcaaatctccctctgcttcccttttatcagaattttatagttacttttgttcaaactacattctgctctaaattcacttgtacatagcttactcatgctgaagaatcaatttgaaagctcatccaagaagctttctcggattcctacagtgcatgaacttgcttttccctggaatagagtcacagaaaacatttgaactgctgtgatgtcattgacaatagtaacaatagataacgtttgtgtggcactccccaagactcaggcattgtgataactaacactttccatgaataatgtcatagaattctcacaaacatcctgtgagatagacactattattttcaaccccatgtacatatgagaatactgagagttggagagactgagtaacatgccctagatgactcagctagcaaggaatgaaaagcacattctaactccacccacatatatagttccaggatcccatctctctacctcacattaattagttctataccagctttatgtttcctactagaatgtgcatgttttaaaggctgagctttctgcatttttatgcccctcctgcacctggcacaatccctgattccatgaataattaattgaaaaagaaataaaaatataaaagaaagaagaaagagatcaaggaaggcagcaaggacagaagaaagtagaaagtagagggagagaagaaggaaggaggggggatgaaggagctggaaatactctgaaaatgtcacccaaagcatctctgtcttagatgttactccaaaaattcctgaagcaggaaaagcatctcccaaggtggccccatcattagttccagtagagagacatggggaggtgggaaaggagatctctccagcacagcatgcctgaaaaacgatgccagaactacacagccttccacaaaagcacgtggagaaaaaaaaacccatccccaaaagcagcattaacaggagaatattaaaccctctaccatggcacagtgaataagacttcaaagccctctacgtatggaaatgaatcctgcaggcaggtttgggagctagagctaggatgccgggcaccagggctgatgaaagcaaaggcagtgtgaagatttgctcagccatgataagtccaggtccccaaagaccctgcccctcccctgcttcattcattcccaggaccctgggagttccagaaggaaaagtgttgtattaacgctcagtaccacaaaccacttggtaagctacctggcttctggaagacagcagtgcccagggttgcctgtgtttgtctttgtgtacacacacaacctatgcgcacacaccccatagagtgacacagaatcatggacaacatagcagctccttgtatgagaagaagcatgtttctcttatgcaattcatctccttactcctcaatgatttattttgttttcatttcttcatccttgagcctaaagctaagggaagaggaaagaatgaacacgggtttcaactctagacctaagagtaatgaaaagggtgaggcagagggaatacaggggagggaagcagcccaggcagaggcattgtgtgcaatactaatgtgaatgctgcccttccattgctcatttttcctaaaggccctgatgtatttttcatccaaacataaattagttttattcatttatttattcaggaatgttgatatcaacactgacacatgccgcctgtacaagagtggggaacgtttttctccctggggcatgaacaggttggggctaaatgaaaggacccaggaatctaaggaagccagggttagaggtgggagggtccatggagataaaagagcccaacttggagctgtgttttctgcagcacaaaggagcccaggagaggactgccaggagccaagcctgtagttaattgaatcctccagccagcaaggcttgctcttgctactcatgctttgttttattattttacattcactcctgtgaatgttcaaccagtatatattgagtacctagtatgtgtcagccacagtctaggtcctaggccttcagtagaaaataaagagttaaaaatccctgaccagatggatttacaacctaaaggagcatcagatgtaaacaagtatgaatcataaccacagctactttctgagagctctcaatgtaccttgcatgactctaagtgcttcagacatagtaaatcacttaatctttacaaaatccctaccgtaatcctgcaatgatagataaggaaactgtggctcaaagagatgacgatcttgcccaaggtcacacagctgataggtggcagagcttggttttcaaactcaggctgtctggcccttactgaattcaagcaaattgaaactaaacaaaaacaaatgcaggttacaactggtgttaagtgccatcaaggaaatgaacaggatgcaatgacgagaaataactgaggcaaagggcttctctggacaaggtagtcagggagggcttctcagaggaggtaacatgtaaactagagaatgctacagattgttaccagaaaatacatacacttccctagtccactttctttaaccttttaacttctttttctcttccaccccatctcttcaccaatatcctcaattctgcagttttcttattagacctacttactctcattaattagttctgtctatccactattaaggttttcttgtaactcccattctgcccattctggcctatattttaatcctcacattgccacttagtgaactaagaggcaaaaaaaaaaaaaaaaggaaaaggaaaaattataccaggcattttccagatgttttattgtctaaccctcagtggaggctcaggggtgttacagaatttttccaaagctacctggcccatgggattacaaagagtaaagatgagactcacttgtactgactctttgtccagagcaccctgttattccatcaaggttttagttacttttttaaaaggatttgcatatctcaaatcaaggtaaggcatagaacactaggaaacagtataaccaacgtagagtttactaacttctgtgctaagtttcttggacaaatgttgtgtaaatgcttggtcaggttcaggatccagtagaatgtacagaattcagatctgtattatcctacagaattcagatccatatactctactgaattctgaacttgaccatgcatttagatagcatttgtccaaccaactaaccaaactcctaacacactcacctgtgcttatttgctacaatcctattatcttagtgcagtaagagttgcccaattctttcattttacagacatgaaaattgataccaaatcaaggacagaatctgggtttcctgacacatcgtttagcagaaataagcaattaaatatggggaaaaataactgtaccatcatatgtgaagtggtaacatagatatcttagatgttctcctgccagtagtgagagtgaacctgttcagggccacctctattccctcaaggtgatacatatgatacatgggtattaaaatcatacagacatgggttcaaatcctatcactgctaacctcaatatattcatttctctgaacttaatttccactgtctgcaaaatgggggccctaatacctatggtttaaggttgttatgaagattaaactggaatacacataaagaaataagattaatgcttgacacagcatttgggctcaatacacacattcttttttgttaattatcattaaattagtcaagacttactagtctacctacaaggctaaagggcatcctgctgcttctgcggtgtgtgttatctgaggtgggatgacctggtatatctggcactggccgacatccaagtagggggctttggagtgaaaactgtggaaaatataatgggagtgaggtcaagaagaaaaggcacatgcagtgtttctccaaaatcatgaagaggttggcggttgagaagcactctctacaatgactaatggactttgtggagaggtgggcttttggagtgagacactttagaaattccttcatagatacattatactgatagcgcacacatagatggctgtcaacaatgagagagcgcttcctgatttagtctctcatttgctctcaccaccacctgggaggttgccccagctcttcactgtgcatacaatatgctagacactgcatgctagatacggctaagtctcctcacgttctcacaacaagcctgtatgtaggtcttatcattaacctcattttataatgaggaaaatcatggttcagagagattaagagtttgccctgaatcacacagctagctagtaaggccttctgctttgtctagtgcaattctctcttgtaaccacacccaattatctgttctttatgtagaaatataaatataaagcaaatgttttttctgaaaatcagaaataggtaataaattaaaaatgagaatgtggtggctacaaccacacaaagaaagcagcggattctcaagggctgggaaggtgtgaattgctaaagaggaacaaaaagacacatctgacctcacatctctccttgtgcaaagtccccagcactggatgacaagggcacatgtgctaaagggcagtgaaggcctagggacctaagtgttatatgtccagctttctgaagactaacatggcatattaatttagatttcaaaaccctgtgcatgctgcttagttggaaactaaaggaaatgaaaagaaattctaatcagggtctattaccagataagaagattacacttaacttacattctcattatttttaatatttgcaaccaacattacaccaagcttaaaatcagagagaagcataatccatttataagcatgaaggtaggtaactggggaggcctgttcagcctaggcctggcacttcaggtcaacccgtctcccaaggtggggaagattaagcaatttggtcaaaggcaaaatgaagtggatattcaaggcaattttccaggtagttcagtctaaaattgaccactctgactcaggatgccaaacaactgagaacataaacaaaatattggggattaactctatttctcttttaactctaccgatactcatttcaatttgccattcttagtctgcatagacataatccaagagatgttaggcagtgtcagatacaagcatgtctctgaaaatgtgtcccatgacaccctatatctacatggcatgaacaggaaagagggtgttctatcgttaaagaaatttaggaaatgttgagataagcaaagagaaatggatctatttactgtaaagttgctcggagcctatttacttgatatgctgatttgtgttctgtatccttaacatgtgtatatgtgtttgtttgggtgtgggtagtcatttgtctacagccttattcttgaccagagctctgcaaatctgggctaagattctttcagctcctttttactgtgagcaaaagggaggcaaagaaagacatctcaacttgtattttataagtgccaaacactttgtataaagccaagggcttcattgctataacattaggttggagtatttcattaataacagatctcctaattcattttttatgatcctgtcagcacatagaggaatttgtctctgtccaaaaaaaaaaaaaaaaaagtgtgtgtagcatctaattgtgtgactcccctccctctgccccattaacttggaaaagaagaattgctggaaaaggtggaggaaagtcaaaacaattgagttgtctttttatggatttattgagtggcaactggtgccatagagagagctaggcaagggcggtgaagcatgccgggaggcccattgatcatcacggacctgggtcaaaaaggattttatcttctgtcctcaaatccaaacggtatgctcatgcacacgcacagcagacaggaagctgccggggcgggtgaaggctcagtcctctccactctagtccctcccaaggagagatcaccaaggtcatagcagggtaaggaacatgatcgtctctgcctggccttagaagtcattgattccagtttgttcccttattaaatgagaaaaaaatgagggccagtgtgcatggcttgcctccctatctaagaaaagttaagtttgcttcgaacttgttgagaatctatcttggactaaattcagcagagatggagaaattagacatggccccctgccttcaggaatctactgttaatgggggtgggggaaagagacaagtgaacttattcatgctgtggagagaggaacacaaaggttcagaaaaaatactgaaaaagaatcgttcactagtccttaagagaccaggcagctctaaaaataagatggttattccttcctccaggaagtggagcttaattgccctctccttcagtgtagactggacttaatgactcacttctaatgaataaagtaagtaaagggaaaaataattgtcttgcagtggaaaaacccaatggacactgccccaaataaatgatgaagactaacatcagcaataagtcaggatgatatcagagactccctgatatgatatgatacaatatgataacaaagggacttcacctctggccagtgcttttcataactgttaagataatttttaaaggaaaacctgagagactgtcacataacagaggaaagcaagtagacataaggattaaatgcaacacagattgaacactgggacaaaaaaaaggacattggtggaaaccgagtaaaatctgaataaagtctatagtatagttaacagcaacatacaaatgttgatttcttagttttgacacatgtaccatgataatgtaagatggtaacattaggggaagctgggtaagtggtatatagaaagtctctgtataatctgtgccaattttctataaatctaaaacatttccaaaattaaaagtctaagaaaaaagatatagtactacagaagggttctgagagattaattactcctgcaagaaaggtttggagaatagagaaataaaaaacaaggctggcacagtggctcaggcctgtaatctcagcactttgggaggccgaggtgggtggatttcttgaggtcaggagtttgagaccagcctggccaatatggtaaaaccccgtctctattaaaaatacaaaaaattagccaagcgtggtcgtgggcacctgtaatcccagctacttgggaggctgaggcaggaaaattgcttgaagctgataggggggtggtggttgcagtgagctgagattgtgctactacgcttcagcctgggcaacagaacgagactccatcttaaaaaaaaaaaggaaagaaagaaaagaaaagaaaaaagaaaagaaaagaaaaatcagagacagtgtagtcagagggaaacataggtccagaatgagagaaaatgtgctcagagcactttgtgtatttgatatgatggcagagcacgctgggcagtggggaatgaggctgggaaatgaagacaatactgtaaagaatcttctacgttaggctaagaatgttagcaagttagcaaagcatttagagcagagaaagcttgtcatatatgaacaaaatgtctagaagttcggtgagctgggaaagacatgcagcaagttatgttcagtactcaagtcacaaagtggagataacagcacgttaaatcacaattaagccatcctaggggaccctgctttggcacgaccgccatgttgcatggtggataggtgaaaaggggattgctttatatgtttttacttgagagactgaaggtggaagcctgcttgctctccttgcaccctcaacgtctacactgctactctctttaacagaagcgcatgacagagcatttaggaaaagatatgggcaactgggagcaactgagaaatgaagtaacaaaaaacttaagatacatccatgatggcaaatctaagctataaagaattggtaggattaaggaaaagagaatacggcaatcccagctcaaaaaccttaatacctacccagtgtctccagagcaaaattcaaacgtctaagcatggcgctcaaggtctattataactttcgagaaactttttgtatttcacttcttcctttcttattgcattttaccacaagtattccaataccacatcttttaaaaactgaaacaaaacaaaaaaaatctgaattcccaaatctcatgcttatgctaagctgttttctcggcctaagctgcctttacttgagtcaaaatcctacactaccattcaatacttcatgcatatatcactgcccccaggaaaccttgcctgactacacaaacaataaaaactgtttctcccttcaagtctctacaattttcaaatttctctctatacaaaatgaaaaggcttctctgcatatataggtggccaatcataaccttttggttaatgagttatgaggtggaatctttggaggcacttctggaaaggttttgttgtaataaaggaaaaagttcacagggaaagctctgttttctgccccttttcttcatgtgtgctttagatgctatattagttcattaatttggatggggggtgctatagccatcttggagccccaaagagaaggccaagacaaccagagagattctagtcctgcacactgacatctggagctgcaaagtcacctatcaccaaagcttttagtcacgtgagtttattaaatgtcctcatcgtctaagcccctgggatacagataaaaatgtcctaagtaaacaccgcttactattaatatctttttaattgaatcaactgtgaagatttcccaacatttgagtccattttgaggaggaaaacctggacttctcaatatacctttatcagagagaaacagtcccttgaatctcacaggctgtgtcttcagccctgggctgaggagaacacaggtcagaccccagaaaacaattactctctcatgagaatttctaatctggcccaagaaacgctattcaaggccaagtcataatcttcttatgacttcatctacctttaaaatgtcaagtactgatttccgctgtactttccctgagagcaattattagtttaatgaggaacatgggccaccatctgcatcccaaaacttgtgacacttgagagatattatctccaccaacctggaacctcctacacattaaacacacagaggtcaaacaaaatattctcctcacattttacagtccaagaatcagagctgagctaatgagaccagaaagaatccacaattggccaacagttgttgagcttccaatgcacagggattgaggcaccaagggatagtagacagaagtggacaaagagtggtaggagaattaccaactactgaactgggaaagccatcccaagcactttatctttagtgtttcttctagtttatccaataattctagaatttaaggattaagatatccattttattgaaaagaaactcagagaaactaagcaaattgttcaaaatttcatcgctcggccaaaaggtaaagacaacccaagtgtccatcaacagatgaatggataaataaaatgtaatatacacatacaatggaataccatttagccataaaaaagaatgaagctttgacatatgcctcatcatggatgaagctttaagacactaggctaagtgatagaagccagatacaaaaagatggagtaagtgacttcacttacatgaaacatcttgaatggataaattcataaggaccgaaaatagatgagaagttatcagggttgggaggtgcatggaatggggagttattgcttaatgattgcagagagtttttatttggggtcatgaaaaagtgttggaaatacatggtgttgatggttgcaccacactatgaatgtaattaatgctgctaaattgtacacttaaaaatggttaaaatggcaaattgtatgttacatatattttaccacagtaaaaaaaaaatcacagcactaataaatgtttcaacagcaatttgagacctcactctggctccaaaatccagagtctttctagcaaaccataaaaagattctctaagatttagtgcggtgctgtccaatagaactttctgcaacaatggaaatgtgttacatctgtactgtccaatatggtcaacactagccacacagggctactgagcacttgaaatctggctactgtgtgctgggcaactaatattttaattttatttaattttaattattttaaatgtaaataatagccacatgttgggtagcacaggttaaactgaagagttgaagcataggttccaaaggaggccttatagcaaaatgatgacaccttggtgctaaaaagatcagtctttcaagttaagacttcagcattgaaaaatgtggccccaatgttccaacaattaccagcacaacctccaacctgttttccttgattttagttcacctttacctccaatccatccattacatggagtaacattgccctaatcgcgccatctgctttctgaaaaccccactaaatacgacccttaaatgcatattactaagtgaaagaagccaatctgaaaaggccacacactctatgcatccaactatgtgacattctggaaaaaagaaaaccatgaagacagcaaaaagaccagcgatagcagtgggttagcatgaagggaaggatgaataggcagagcacagaggatttttagggcagcggaaccattctgtatgaataacagtggtgaatacacatttttatacatttgaccacacaacaccaaaagtgaaccccaatataaactatggactttgggtgacaatgatgtgtctatgcaggtttgttaattgtaacaaaagtactactctggtgggaagatgtattgatactgggacaggctatgtgtggtggggaagggcggaaggtactcgggagtataaggaactctctgtacttcctgcttaatctttctataagcctaaaactacccccaaaaatgaaactgtttacaaagaaaacaccattaaaactcattattccatggcagatgaggcccctcatcatctggcctctgcctctcctcctgtctcttttctcattgccccctctccctgtgcatgccatatgccagctccctacactcatcaagctgtttctcactgcaggggctttgcatatgctagtcactctgaattgaatgctgctcacctttctaccagaactgcctctagagctttcaaaacccaaatccccctttttgaatactttcttgagccatgaaaactgagttaactactccctcttgtgtgcacccatgcactgagtaagtatcacagctcatatcattgttttgttactgatctgtcttttctaacagtctctgtgttgcttcaggtaggtcttactccttcccaccagaccttatatgatctggctccaggcaatctcttaagactccatccctcctccttccctccctccagcaacacaggccttgcctgatcctagaacacacagaactccccactgccatagtcttcccaacatctcttccccgtactagaacctactccacagtgagctcaaatgcatcctacagctcaaacctcaacttttaggaaagacttccctgaatccccagactaaaataaatgccctagttataagttatcaaaatactcaacgattcttccttcaaggcatttgccctaaacacatctatactatttataaaagtatttgttcaatatttgtcttctccactatattttaagctccttgtcctgttttttttaatccatgagtccttacccagtgtatatttctttaatatgaacaccttattaaaatgaacaaatttccctttactccaggggtcagggtgggtgcttaataattatttgtgaaatgactgtatttcatttatatccaagatctaagagagtccctgacagatagtgaatagtcagcaaattcagtatttgttgaacaaacaagtgaatggaaagttcagaaatcttggcacaaatgaaatattcaactcctttatggtaaaaatgattcaaacccatattcagagtttcagactgaagaggctgctgcaagtgaggacaaaaataatactatgtgtgtgataacaacatttattttcatttacctagtattttcaagcatgccctcctaccttactctttcagtaacgctgtgtgctggataatacaaacccacttctagaaaagggcaatggagtgcagagagaggacatggctcgccacatgtaatgtactgagctagtggacaaccagacaccaggctgcttagctcccaggcaaaggcagaaggtgggagtggaggctgaggggctgccaggacagaaaagcaaaacaagtcctcaagattcctgggtaccagagccggatggggagagacagaatggactctgattacaatctgaggaggattcatctgctgaaagagagttgattggattgtgctgtgatgccagagtctgtcggcaatcaaacaccctctggctacctctgagcatctggaattggaaagctggaggcagaggccggcttgcagctgggggccatgctgggggacatgggagcagctcagcttcaggctgcagtaaagtggtcaatggcatgcttgtccattccaagcacttgctaatgaaaaatgtttcccccagagaacccagagaaggggagcagcctacactggagatcaggggacagagggaaatggaaatattccttacaattgcagagtgtgccggtgcttacaaacatttaacttatgctatcactagatcctcccccaaaccctactgaattcattgccgtcatccccattttgtctatgcacaaatcccaagttagtagaaaggaaatgtctcactcaaagatacaaggtataagtagtagagccaagatgagaatgccaagtatgtctgattctctattaacaactttcttgtaattataatccaaagcaaaagtcttcatcataaagtcaaaatcttaaaatatgcagggggttagacttttccagggagataaatatgcatctcgattcttcttggacacctactgtgtgctggtagatatgccacatgggccatgacatatgtggtgagattattatcccatgtttgatacgatgaaattaagtgagaatctgagaaatgaaatcatttactgcaagtggcatggccatcaattaaaatcagaccaaattctttagatttcactttgagaactgaggagcaagagcagtgcaggaacatagcttctttaccctctctcaagaagtatgccagcactggctctacagtaaaacagtgatatcttttctgttcaatctgatcttcaattttaatgcgcttccatgtaaaatacgggtgcttaaaatataaaaaagaaaattagagtatgtcaaaaatggttaggaaaggggaatttagagaacaaatgaaggaaggtaaaaaaaatactggaaaacaatctctcttcataccatctcaggaaagataaagaattgagtatgggccaagtgcagtggctcacgcctgtaatctcagcatttgggaggctgaggtgggtgaatcacttgaggtcaggagctcaagaccagcctggccaacatggtgaaaccctgtctctactaaaaatacaaaaattagccgggtctggtgggcgcatgcctgtaatgccagctacttgggaggtggaggcaagagaatcacttgaacccgggaagcggaggttgcagtgagccgacatcatgccactgcactccagcctaggtgacacagcaatactccatctcaaaataaaacaaaaaaagaattgaatatgaagcatgtgctaccaaggctgacttacccatcaggtacagtgtccagggctcatagtcctttcaggagccaacagaaatgttttaatttttcttaaaactacatgcaaatttaaaaatgtatttttaagtcaaaagaatttttaatataaatatgaatataaacatctttgacacaattttacaatattttaaattaatcataataatttcgtaatgtttttattaaggaaggatccacaaaggtaaaggtgcctaggcttgcaaaagtcacacagtgaacctgcattatgactttgagattatcaccgtggccactgagtgtggagcacaaatgaactaatgaggattcacagagttgaggaagagtgttttcagctatgttctgatgaacatttgaatggagtttccatgggcacagcaggttcagagtgttaccaagagaattggaaatactcctggatgcaggtgagcatttctcccttagccaggccaagcagagaaggtggaattaaagtcacctttagtgttatcattttctctatctcaagagtttattatggatccttggaaccacaggagattggaattaatgtctagtcttgagttaagaatgttatatcatgcctaacttaaatcctgcctattttgactagagtctttaattttgcttttttaaagaatgaaaatttacaaacgttacttctcctgtaattgctgtgaggatttacttgcaataaggtcctcttggaagtctgggtacctaaccctttggagggatgaacagagtacctgaatggtgataagaaggcaaagattgtagaaacagctaaatcataaatttttgtgacgtgggcaagtcacttctcttttttggtcttagttttcactacctgaaaaagtcaagttatttgtatatgtaaagttgaagtttcttttaatactgaacacgtgggaaatcacagatggtcctatcccagaccccgatatggtaaagtcagtgatataatgaggatcgatcatacttagcgtttaagaagccttctagtttcctcaaaatccaggatatgcctattagtttccctacaggaagcatcattcctaagaatttgcagagggagagaaagtaaaggtcagacaggttaggtaatacatatgcatacatgtgcagacacacacacacacacacacacacacacacacacatacacatccacatccacacacatacccaaggccacaaagcaaatctggggtattgtcagtttcaatctctggcaacaggaaaaggtgagggtgtggctccatcccctgaatgagtgtaacattacaaataccttagtcctaaggttgcaaactctgattttgggcctgatagcacaatgagaaatcccatttccttcccaatcatttgaatgcgaaaggggccagcattaaactgggggcaattgtctttacatcaccctgggcaccatttctaatcacagacttgtcgaccaccagcctcttgtggcacctagatggagtgcggaaattatcatgtaatttacaacaggcagtgcctgaaagtgactttctcagcatctgctctctagtagtcccaagagcagagaaacgaagaaagttcatgggctgctggagaaatgcaatctcctccagttgcatccaactgttcaacagcctccctccaaacccctcaaacagatcccttacctctgcttctctcattctgtcgttcctctccccatccctgctgcttgaagttctattcatccttgagaacttcccttcatatatcccacctttctgcaaaggcctacccaaccaaactcacctctcactagcttcttcctgaaacgttgatctccaacatcggtgaatggtgggaggttaagcaaggtttaaatttgatctaaatataattcctctaagagtaaacctggatggactctcaggtccctcagagcccttttctctgtgcaaaacaatgcatagattcaacataaaacagtgtctaatgtgaaaaggatcaaacttgtattctggacaattccattccagtcctctttcctgttctgtaccttcctaaacccgtgctcttgagcaagctgcttcaaactgagaacctcagagtccccatctgtaaaatggaaagtgcttaaaccttaatggttgttttgaggattaacaggaacaacaataaaaaaagattgtagacatgacacaatgtaaatgcaaggaataattatggttatccctccaataggaacaactgatgtggcaagtaaagtaacaaataaacttgatattttccatttttggctcaagaaaggcaaaagctgtcttcacgatgtatctgttgcatgctgagataaggctttagtcattctactatgaattaaaagatattgttaagcatcttctatgtacgcatgtaggtcccagcagtagggaaagtaccatcaaaataagatgcaaagaattgtcctttgtgccttaactttgttgaaccatatggttcttgaaatctgtgggtgcctgtctggttatggggagtcttctgatcagtagccagcacagtgtagatgtcattctaatgtcgtctatacattgaggaaagaacacaggaattgaggtctttaactatcagagacagggggaaggagtggagtcagggattgcagattcaactgtgacatggccactcagctgtggtgtgagcctgcatcagtaactgtacttttctgagcctctgtttccctgaaagtagggaaagagagaaatgatgactagatcaagcaataataagtggatgaagaaaacatatagaggcaggagttaagaagtcagatggcggtgaacatcggcttttctcagaaggaataaacccaagaataagagaaagtagatgcaagcccgttggctttgactggttgctaaatataaagtagtagaagccaatgaagatcttattgactctgacccctagtgtgtgtgtgcagctgtccggcacatagagattcttggattacactctgaggttaggactgtcttggtttcattcttccatgtaactgtcaaacatttgctgaatatgtttggctctgtgctcggcaaacttactggaaaaataagaggaaaacaagaatgtcacaatccctgctatcaaagagcttatggtttagtgggtaatacaggcaattaaataggtaatgagggtgaagtgtaatgtggaaatcaagaaagagtccagggaatatgggagtatacaacagcaggtgtctaaccgagctggtagtcagagagggcctctcattttaaatgttatatggtgtgagaatttaaggacaaacagaagagatccaggcaaaaaagtggaaactataccaaagcaagaaaagagcaagtgcgctggggatatggagatgagcaggggataattcccaccctcgtggagctgctggtctaatggagagagtattgaacaaacagccatcctaataacatatcgtatgagctgtgcagataaccagaattgatgaggtttctttccaagttcatgactccatggtgagcatgctatgttctgagggtcactggaactgagcagccaacctgatttcaaggcctggctttactagtggcactctgtgtgactatggacaaggaccttcccctctctacccccagtctctccatctgtaaaatgaggtacttatattagataactgtgcatatacttttgtactctaaaaatctgtgctttagaatgacttagcatttttctggatcccttctttgcttctaatagaaacagtttttttcccccttccacattatgcccctttatgtagaattggtgacattatttatttctcatatcctcaggacttaaatccccgaattattctaaatcttgcccagacctgacaccacaaataaattctcaatctcagggggattgagacaaatgggggcttgccactcctgtgacctccatcagggatttggctccaacattctactcaaggaaaatgttgcaccaagtcaggctagaggggaaaggagaacattttttaaaaaacagccgagcatttgtgaaaagacaaaagaagtggctttcccctggatgcacatccaagacctccagcagattggagagcatttaattttgagtctttgcttcttgttctcaaaaggaaacaggattcacctaagtgggaggcggccagcatagcaagtcgctcccatgcatggggtcgtgtagggccgacttggaatcctagctccaactccaccctcattaaattctgtgtgacctggacaagtcatttcattgtctcatagactcagtttccccagctgtaaagtaaagataccatcaccacctcagggagttgctgtaagagtaaaacaaaactgcataggttgaatacctactacagggttgcaacacattgagtaatgaaaagcaggcaaactaaaccagaatgagggctctgcagaaagctggcaggaaatgtcaatggcgctcagctcactggtgccagatatctcccatggggcagttccctggaccctaaaaaggcaagggaaaatatatagtctaatagaaagcatatgagcattggaatctaactgttgagtgtaaattttatctataccaatctctaggacccttctcactcctctaaacctcagcttcctcatatataaaaaatagtacctatctaggttgttttgaggatttaaaaatatatatattgcatatcaagttcttaatatgatacccagcagataacatgtacacagtgaatgatggctaagatttaggatcaccctgcattttgtttgattcctatcacatgcttggttttgtttgtttgttttgttttgctttgagatggagtttcattcttgtcacccaaggctggagtgcagtagcgcaatctctgctcactgcaacctccacctcctgggttcaggtgattctcctgccttagcctcccaagtggctggtattacaggcatgcaccaacaggtccagctaattttgaagttttaatagagacggggttttgccatgttggccaggctggtctcaaactcctgatctcaggtgatataactaccttggcctcccaaagtgctgggattacgagcgtgagccactgtgcccagcctttttgtgtgtgtgctttgagacagttcccatgcttgttatcttccatttgctctgtcccatactaaaccattttctgcagtgctcgttgcccccggaaaaaatcaaaacctgtgtcatccaagttatcttgcctgcagctttcagttgggttctgctaaagagaggccctggtggtagatcagtgggcaggtaagggagagataggtcagggtatttattatcctccctccatccctgctgacctgtggcctcaacagtgggtgagggggtcctatggccagtctctataagggagttcctctttctcaaatcaatgttccctttcctggctccttcaggatggcaagagcttcctcttgtaatgagaagtctgattccttgttttgatgtttgactataaacagcttttaagtctcaccacctccctcttcaccaccaccaccactgtgccccatatctgggcaatctggtaggaatgactggacgctccctcctttggtgttggctgaggattctaaccatgaaagtcctgcctgagtgtggaaactctcactctggccccactctcgtgccacagtaaaaacccacaccagtctcttttcctggctctctagtcattctggaattgtgtgagaagcctgctctgctccctagaaatttcacttatataactaataagcctcttcctaccctcttggtgtgtgtgtaccatcattagtttcaatatccaaaccaaatttggggtggggatctctcctgcttttacaatgaccaaaatacccctgatgccagcctgcaatgcctcattgccccgggtccattcccttagccctgcccacacccttcattaaatgctctactgttacctcttctgagtatgttcagaagggagctatctgtttcctgccaggaccctgactgatgtaacaccgaaggtccatgtgtacgttcattcatgaagcatctgttaatcacctacttatacaagttatactgtgtctgaggggagtgtgtagtgaaggaaggctttacagaaagagaaataaaacaaatactttacacacattatctcatttcgttctctcaacagccctgcaaattggcatcattagtcccattctataagtaaaacaaagcgcagaagaaatatgaaaattgttcaaggtaacacagcatctttatggtggaagggaggtaagaatctaggactaactccattctaacctcccgcctccctttatggagacacaagcacccgtgattgcagtacagaggagaacatgtatgaaatgccagcagaacatgctgtgaaagatcagcagatagagaggacatttttggttacagttaagggcctcagagaaggtggcatatttaataggcttaaaagtatgggtaggatttgaagatacagagattaggaggagtcaaaaggggataaggctacataaaacaggtctgttatcagtgcccaggacatgatgtagagaggtgggacaggtaagttgaaccttggcattaaagacctcgtatcaccagccatctctccttatttcatgcagtcatgcctcagccaccggcagacatctatcttttctcttgacctactaggattgtgtagtgcataggaattctttatggaatctcagtttcctcatccgcaagcgtgggctgttttgttttgtatccacctgtctaaacgtggattaaatccattagtagcatgatagtttggaatggttcctaatagttaacattttctgagtcatattcacagtaactgacatcttgttttctctatccccctctactagcctttaagccatgtgattgaagatggcatgacccacatatattccctctacaacaccccacagagtaggcatccaataatttcagaagagtaaattcatgtagtccagcttccccctctgataacttagaaaattcaagaccagggagatagtgacttgttcaaggtcttagccaagccgattaatatctctacccaagcatcaacccaataaagaccaactcttagaactcatcatgaagggcttgtttttcaagcattgggctacattttgccaacctctgtttgccactgcagatgtaaggttaaagaaagaaatgggccaggtgagtctttctgtgagcaaagaaaaatatgagccttttgaacttgcctgaattatctgacaagtttaatcaagtatgaaataaaaagcaggcatgatttacttagttttccaaaatgcagttgatgaggtaccccacgaaagattattgaggaagataaatagctgaagagcggggtttaaaatgaagttgtggcataggaggcaagtgaggctcaggactcaaaggtctggcagctatagaaatgaagagatgctagtttataaccctgagaaaagcatcctatgcttatagaagcatctgggcttaaacttaagttacgaagtctatcaggaaccatggacgtccacactgcattctataatgagacacaataaataagaaaagaggcacattaagtaaataaaaaagaaaagagccaggcatggtggctcatgcctgtaatcccagcactttggaaggccaaggtgggtggatcacttgagctcaggagtttgagactagcctaggcaacatagtgagactccatctctacaacacacacacacacacacacacacacacacacacacacacacacacacaaaatcagccatgcattatggcatgcacccgtagttccagctactcaggaggctgggaaaggattgcttgaaccctggaggtagaggttgcagtaagccaacatcacttcactgcactccagcctgggcactggagcaaaaccctgtctcagacaaaaacaaacaaacaaaaacaaaaacaacaaaaaaaagaaaaaatgaagggaaggaaggaaggaaggaaggaaaaagaaagcaagaaagaaagagagagagaaacagagagaaaaaaagacagaaagaaagaaagaaatagaaagaaaaagaaagaaagaaaaagaaagaaagaaagaaagaaagagagaaaagaaaagaaaagagaaagaaagaaagaattagagtatgcttcaattacaacttccacatctcaggtttcactcatgctatatgttcattccaggttggcagggtgtctcagctcgtcattgtctcaaaatgacccaggctgatggggcagacaatatctgaaacattgccaaactccatgtgagagggaaaaaagaaagggctctggagagcccttccttgacaggtaaatgctctggtccatgagtggcattcaccacttccactcacagttatgtgagccatcccagtaaaaatagaccaggaagtgcaacccaagcgtgtacccataaaggagaggaatcagaaatatttgacaaagcaatgctaacagtttggccaacagatcctcccatgaaagtccacaatgttctgatgatgtggcgaggccccaggagcatctgagctttgccaagggtgaaggcagcttgtattggacagtggaaatgcactggcctaggggtttggaggtatcttaggcaggccacttctcttattgctgtttgtaggtgatgctctatgagctccttcccagctctttccaaggagcagattcaccattgcagaatgtgacaagttaacatagcattctgtttgttctgcgctcctgacacattacataactcatcctgatctgccattatccaaggcctctgttcgtttccccttgtaaactccttgagggcagaggccttgtctcactcatcttgcaaaacctagcaccgctgctacatactggaggcactcactgtgtgtttattgaataaatacacagataaagatttccaaaaccgatgactttcaggagtcaagccagtcagctcagtagatgtcccaattaatacactcaatgatcatgctgacaatggcaatgacaagctgacaatgttaatgataaatattaataatttaataagtaatattaaactatatagggcactttccaatgtacagatcccttttacctctattctctcctttgatgctctcatcaaccctgtgtgggaagcagagcagaaattggcatccctgttttatacagaagggaagtgaggtcccaaaaggttaatgggactttctccaagattacccagctcatcaatgtagatctgggacaaaaatttaaatcttttcattccctgaccatgatcttttcataagaaatcccccctctctctaactcctctgagaacacaggaatgagcccttattgtactatgagtacccaatttttcctgcatcttcctgattagactcctgagccatctcatgacctcagtattggtgtctgagctcctgcaccctccaaggctgcccactgtgccgccctgctccagcaactgtagctctctggaaacacctgctctgaaccacaaatagcgtctacttcatcttctcttttttttttctgagacgcagtctcactctgtctcccaggctggagcacggtggcatgatctcatctcactgcaacctccgcctcctgggttcaagtgattctcctgcctcagcctcctgagtagctgggactacaggtgcacaccactacactcagctaatttttgtatttttagtagagacagggtttcaccatgttggtcaggctgatcttgaactcctgaccttgtgatccacctacctcagcctctcaaagttctgggattacaagtgtgagccaccgtacctggccattccatcttctttttcagtgagcactctactaaggacattctcacagcagaatagaggctgtcttacatagacttgctatttccccattttgtgtgctgttttgtggcaacaatagtcaacagaagtgaactacaacaaaaacaaggcatactattgtgcaggattctctcagtgattccttgtaacagcaaggccacccacttcacaggtggcaagcttgaagtctatagcaattaagtgacagaaaagggagtacagtgatgagtggggagcatgagctatggagcaacagccagacctgtgctctcatgctggctctgccacttaccagctctgtgaccatttgctatttactaatacctgtatacttcaaatgcgttttctgtaaagaagggacattttcatgatcctctgggggtcatggtaaagagaagggtgtgtgtgtgtgtgaagcttttgcagaagtccctgctcatggtaaacattgaacatatgagttccttcttcattgtctgccttcccttcagacggtaagctcctaacaggtaaggtgctctgtctgtggtcacagctgcctccctagggtctaatacagttcctgagctaggatggatgctttctaaactcttgtaattattatgtgacttaatcaggtttgcagagatatttatctataaaatcactgaggcttttgcttctcagacatatagaacttggctacctctaacccagtgttatttttagcttcagttagaatcatagaaacctggaggaaggagggactttaggtcagcccctgttcatttgcacgagttacctctgcaatgccctatcttattatcatatgagttctgtacaatatttcactccatggtatggagtatgtgctcttttcacaaacaacttccacttgcagctccttagtttcttgcttgtaaatagaatgccaatcccaggtcccagcctgaccaccagaaaagtgagcttgaatagaagatgatgttctggaagctaacgatccgcaagtcagcagactttaagcagcaactaaggataagggattcaaaaaactagtgtaatgtttatgtagcaattcttcatcacccttgaaaaggcacagcaacaaaaatagcttccagggatctagaagtcttatcaaataggggggttttggaaatataccagtgggtgtgcatgcacatgcgcacacatgtgcatgcacacacacacattcacaatttaatcttatactcaatacaaacaaaagaagttatccattggaacaaaaacacaaaaagaatgttccagaaacattgccatggtattgaaattgaagaaaatgatcatacccattttccattacaaaatctgtatctaattttaaagtttaaagaacaaacgaatctgctgtgtttgagtaggataagcatagaattatactttccatctcccttcttaatttttgcaatgtgtgtaacaggtgagtttttccattatcattgagttaacacacaggggtgagagacagtatcctaatcttgtactgaaaggtgaaggtaaacaactttctttttttctatactattcgtcagaactcccttagtttccaggggaccagaataacaattgtcatgtgctgtttagaagaactgatctgaaaaactcatatataaaaataacatacatttttaacatgttggtttataaatataaaaatcccattatcacaaagccacagttggccaagtccccactgacaaaggattactgtgcctttaacacagtatgaagaacaatcatttataagcttaaggaacgccctgaaccttgattgcaggtgttggcacagaatagttctgcttgaacttaggtcaagtaaaacggggtaaattgatctaaatcatcatttacttaagggaaactaaagtgttgctaatgaagatagaaaatcttacaacaaacacaagataatacttgccaacaaaagcacaggccagcctggattaacaaattctctaagtgtttttccccatcatggctatttgttaaacctggaagagtgctattcaaatgcaaagctcttctacttgttgttaattatattattttctttttctaggcaccagtgatcctgattgctcttggaacctcttgggaaataagcctccatgtaacatgattataatgattcattatatttgggtaggttttgtagcttaaaagtgcttttccatctatttttaatattatcattattaataataatagctaccatttattgtgtgcttttcaggggccaggcaccattcagtgaacagcaaacacagtatctctactctttacgataaccctgcaaggaggttgcaatacccatttcatatggtagaaaactgaggctcctacaggtcaaatagcctgcccaagatcatatagaccctgcctgcctgaccccacaatccaggccatttttgctttaagtatgacatattatatgatcttaaagtcatctgtctactatctattatctgtcattcttttagactaaacactctttgaaggcagaaactatatcctgttcagagtcataatctcactaccaagcacagtccctgggacactgtaggcacttgatgaatacttgctaaaagaataaatgaacacatgagtaagtgagtgaagtcttataggttcttctactgaggcaggaagatcatttggtacttttcctgttaataaactgggatgcagaggctttaacaagagaattgatttccctaagggcacacactgttaagcattagaggaggaaccccatccacacccttctaacttctggtcttttggggattccacaggcccaggttgcctctttattacattaaaaaaaaattcatatttgtcatggcacgctagttaacaagcgatgagcgggaagctacaggttggccctaagtccaggtatattacccacctccctccacactgccacccttctattaaccccacttggaagcccatgaatgattatgaatataaatgtgaaggctcctcctttgaggtagatgagggcggggaaagagaagatggagaacagacaattcagacagccaaattcaatttgagggaatttggttcagtgctttccattaacaacactcaacgaaaaatataattcccaggacaaaagaagaaaagggaaaaaacaacaaaaaacaaaagcaacttttcatcatgcacagtcaatggaaaacaaatcaatcaccctgtttctccctggcccagcaatgcctcggtgaacaccaaaggcacacggcctctaagctgttgttgagtcctcagggtggtactgggagaaagaagtatctgaaaaagaaatagatggccaaaaatgtcatccatgttctagccttcttcaatcttccaaagaacatgttacagtttagaaagcactttacctaattcagtcatctgatactcacaaaacctttttaaagtaggtactattatagctcctattttattaaatataaacaagaaaatgagtcagagtaattaagtaatctgcttaagatcaggcagctaataagtgtccagaaattaaattcaggttcctttaacccccacatgtcaaactcttttttttccccctagagacagagtcttgctctgttggccaggctggagtgcagtgatgaaatcatagctctctcaatgcagcctcacactcctgagatcaagtcatcctcccacctctgcctcctaagtagctgggatacaggcatgagccacaactcctggcctaagcttaaattctacattatcaaatgcccccaacaatcccaagggagggcaaaaactaaacccagttggatgtccctacattattaaataaccacaacaatctgaagggaaggccaagactaaatccagttggatgtccctaccttatcaaatacccccaacagtcccaaagaagggccaaaattaaacccagctggatgtccctacttcatcatatacccaaaacaatcccaacagagggccaagactaaacctagctggatgtccctacattatcaaatacccataacaatcctaagggagggccaagagtaaacccagctggatgtccctacattatcaaatacccataacaatcccgagggaaggccaagactaaatccagttggacattccgcacacaactggggatttttcattccaagtcaaactcatcccaacataaaaactaaaagggtctatatatttttaatatggtaacatccctccctgccttgcctccctaatccaagcaaaacttgaacaaaaatagcaaggcctcaaattctcgtagtgctattcctgtaaagtgtcctttcacctgctgacagccagttggggagcaatgtttccaaggaatgtttccaaggaagttaaaaacacaaacttaggagctggataacgtggatttgaatcccatcttccccccaatagttgtgtgaccttcagcaaggctcagaatctccttgtgcctcaatttcttgatctgtaaagtcagaatagagtcacatctcatctcatagggttgtcgtgaggattaataatacctgaagcacttagtgtctgaaagatggaaagcatttcataaaattgttattattgctaggtgtcaaagcactgatggatcatcagtggatttaggatgctaaattaaggaggctcctgtagagtgtaattttctcattctacagaggaaataactgagactcagagagaagaaaccccacccgccacctttcacacaggttcattcagagagccagtgatgatctcctacacccaggcagggctcttcgtctgccttgcatacctgtctcaaagttcttgcatttcaggagcattcacccgaaaggagcttcccttctctcatttgtgagaagtggtagactggtcctaactgagtagggtttgcagggaatctttaacactacttggcaaagtagatactgatatttctagtgccttgttgagcatcctcaatatagaagctgtaagaggcccgactgcagtccccgaggccagtgtgtgcacattagcatccagtcaatgcaatgactcaaagggtgattatgtccttggcacattagccctgcacctgcctcttcctctctctttccaatgccctttgatcatttactggctcattgaatcttcccccagagggtgaagaaggaagaaggagcctaagtcaatgatcagtcagatattggtactagttagcaagtcttaccaaaccttctgatgcaatggctagatctgcactcctggaccccattcatatggccatttgagaggtgagggatgtttccataatcacaagctagaatcctgaattggaaggcttcaaatgctaatgctgctgcctattagctatgtatatttaggtaactcacttcatctcactgagcctcagtttcctttcatctgcaaactggatataataacagtacgtaattcaaaatgttacaagaattaaatgagatgataaatacaaagcatacaatacaataaaatgcctggcacatagcaggttctgaatacatgatattgaattaattttatctattattaatagatttaaaaatttttaaatatgttctggctaatctgtgcaccaaacccttagggtttgcagcttgtcactttttccctgctaacccctggatggtgttggctgcagggaggaatcctttgcaaattcctcaagcagattcttgtttgtaagcacattggaacaaagaggaacaaaataaaaacttggatttggaaccggaatatttctacttgattctcgtggttctaacacttcttagatgtagcatcatgtctggtaagtcactgaacttctctgagactcagttttctcatttctacattggggatgatggtgctccctgatttgccacctgaaagtgagcatggggcaaggttcattgctgtcattcgcatcattgttattagaggaacacactcattattattgagggctaagtatgagccacgcatttaaaatttatctaattttatgcccatactgaaaagtcagtgttaattattccatttacagatgcagaaattatggcttataaacaaactccttaaaagacttctatagatttttgtgatacccatctgcttaaactccgttaagtcttgcttgtgttccactggctgctaagatgctttttaatgacattttattatttgttatttgagaacatgtttatctgtgtgaggtgctcaagccaaggaaagggttatctttattttggcttccctggtaccacccagggtgccttgtatttaacagataccagtaaactattatccattgtagtagaaaacttcaaggtcaaactaagggatgcagaccagtgaaatatgctcttgtaatgtgaggaacatccattcagaaaggcctcttttgaaggggaaatgtgattatagagatgcagagattatcaagagttcatagaaggaacccaggtgggaaatcagacagcaaactggaacatattcctgccttcataatgagggagaaaggaaattagtgatgattctaaggtggcaaaggtcctgatctcatcttttatgatctgtattttgccagaaaaagaaaagaaaagaaatgtggacaattaggaagtaattaagatctcacagaagtatctacgacagaaagcagttaaggaaatacttagggatttgggggaaaacacaaattagcaggttggacagcacatatcctaacatgttccagggaagagctaatagagttactgaagcacttaatgattatttctgagaagtcactgaagaacagcagcagaacatacgcttaaattttttacaacatcaaatgtcatattgatcttttagacagaaggggaaaaatacatgaaatagaagctttaagaatgaagaaagtgggggaaatacttgcaactgttatgtggcagatattttcagatatagcaacccattcaatcgtccacttgtaagccagccctggattcttcccattttccagactaggaagcagggcttaggatggggaagcaaatcatccaagacagccactaatcattgctcgagctgggattcaccccagtctctgcctcatgctggcaggacccatgtcttgccatttttattgctcttctataacaaggattaacaaattggacacaacccaggaaaacaaaagaattatgaggctgcataagggcagggttaaaaaaaaaaaaaaaaaaaaaaaagcacagatcgcagcccgcaaacatgagagcttttcaatagaattacaaagacaatggatgaaaagatcacaagatgacttaatctggaccacaataactcaaaaatgtttctcacaaaattaattcaaatggactgggagaggctgcatagctgcaaggcttgaaaattaactcaaaggcagtaaacaaagaataatgatggaaataattcaaatacaaaagaaggcaccaagtctggtagagctcaaagccccttgcaatgtcattttattaatcctcctggcaaattgacaatgcagcaggactgggagaggtatagtcttgctgaataaagcctcattttgagacctggggttaacagaagtaaggtacaaataagggctagtttctcaccaggagcacctaccaaaggaaaagaggagctgtaggcattgcatgaaggagaaataatccaggttgaccagaagcctgactatctggacaaaccgaatactgtcaacccagaattgaagacccatcatttcagatcctgctcagcttctgtggttccccaccctgtctttttccagttgactcagctaccaagatcatctttagaaccaatccttcttcctctggatctccctaatcccaaatccttacctagactggggtttacttagttagtactagatcaaattccctcccagcacgttcagtttcaacaagaaacatcctcctgtacatgtatgcaccacacactgttagtttgtaaggacagagagatggacaagggaagagtccttggcctgccctctagggctcagtctggagggaaatgtctgggccagagtttgcatggtatattcatttaaccttgcctgaatttgtgtttggaaggtcatcatccttcacaaaagttcaagtttattctccaagggtcaaagagttaacaaataccacagtccagcattcaaaactctgtctctctggcacaaaagcccatgttttctccatttgactacacaaagctcatcaaagccttccacaaccaatgtctgtaccaccagttcacagtcgtaggtcaaggaaaataataacttccacgagcaagcatttattttgtgccaggaattttgtttaacacatgatcttatacagtcctcataaatcctattagagtcatcattaaccacgtattgcacgtgaggaaatggaagttcaagaaggaaaaagtgaaacacagcttgcaagtacagaagcaggagattcaagctcaagtccatctgccctacagactttaagcccaccacttagtgaggatgtgtgtgagtttcccattgctgctgtaacgaatgaccacaaacttagtggcataaaacagtgcaaacagttttgcaggtcggaagtccaaagtgggcttttgtggggcaaaatcaaggtgtcagcagggctgcattcccttctggaggctcttggggatagcccctttccttgtcttttccagctcctagagtttcattccttgtctcctggcaccttcctcccacttcaaagccctcaagtctctctgtatgtctatcttcacatccccctcgatgagtctaatgccactgcctgattcttataaggacacagtgattacatagggcccacctagataatccagtataatcttttcatcccaagatctttaacctaatcacatctacaaagtctctttttccatatggcatagaatattcacaggttagtaaattaggatatggacatctttgggggaccattattgagcccaccacaggatggcagaagcacacttaactgtagtagaaaccctaataagctcattttgctaaagaagacactgaggttcatagaggtaaagtgagtactttgggacatgtgtaagtggcaagataggaatctgaacccaaactagtacaatatcaaactccattttctccccttcccatagtatgtcgcctccaggaaaatgtcagacagataaaccatttggcactttcaaatggataaatggccaattcaaaatgaataatccttatgaatgattttaagacagatttggtgattctctgggttgatgggagtagttgtaggtgatctgccactttgcattttaggaaataccaagaaatatttaggggttagctgaatgttgataagtgtgacaaaaggcaaaatttttccttctcagcagccaggcaaagcaggatttgtgggaggagcgaagcctgagctaaatagactagatatggattcaagctccagatcttctgactgtagtcacaaccaggctgtgtcacatttctgggatcagtttctgaactggaaaatcggggctatgatgttttcttgggaagaaaaaatgagataatgcctgtgtggtgtccaacattgcatctagcacatcataggagctcaataaatggtaggcatttttattttctctcctctgtcctgatttcaggttttagagtaagaaacaaagacatctggcctttgtttgaagacagaccgctagctgtgcaactaatctttaaaaaaaaacaaccactcccttctcttgcctatgctcaaggtacagctgagagcttagaaactccaggcagacaaacgaaggaaggcaggtggataaaggaaaagctcagccatccatcagaccaagaggggataaatgcaatgcattattcagggagttcagtggtgggcctctgctaggaatggatgagggagttggagaggtcttttgaactcctcgggatttggccgaaagccgagagaggccagatgccacagcacctattagtcagctgttggccagcccttggcgatccactgggactgtttcaggaagcccagggctctgaatagggcaggaggttaaccaagccacctccccattctgcaaagccttttctaaaaccctgttttggaagctatgcaggcactaaactgcaggaaaccaggcagagaaggcccttggggcaggacccgcctcacctgtaaacagaattgctaatggcttgcagagggtggtttgactggtgatggacagcatcctgaacccataaacgtcccatgcatttgttgccatatctaaaattacaccttgactctctgagtgtaaattaggatcgctttttaagagggcatttcagcaatatctatgaaaattaaaaagtccatatttttgacctcataatactgctgctgagtaacttacagaaatgcacatggcaagaagctatatataaatatatatatataatatatacacaaaaaagttcactgtagcatacttttaataacataaatgtccatcaataggaaataaattatagtaatcaatactacagaataatgtcattacaaataatgatatggatccaaatattctaatgttgaaagatttccaatcattttaaagtaaaaaacaaagatacacatacaagtgtcaaaataatagcgcaatgattctgtattggaggaaatgacagatgcatatttggatttatccatacatgtggctataattaaagagaaaaataagtgagaagaataaacacccgttaccagtgatagtctctgggtaggaaagtgagaaaggggatgcagaatggaactatcactttctaccccacatgattttgttgcgtttatatttttataaaaggaatggctttatatgttaattctgtaattttgaaaagtataaattaaacaatgaaattcatttccacaggtgatgagaacaacaaaaggcttggcaggtaggttcacatcatcatttctcagatgggagagcagacaagacagaagaagagacctgtctaacatcacagagtggggtcagggagtagatccagggctcctggtacctagtccagagtgtttccaccatcttcaaggtctagatctttgggtgtccatgttatggaggcagatttccactggatagcaggggaactttatatgacacaatacctgggaataatgtgttgtggtggtcttgttcaggatgctatctctgccactggctggcctgtggcctcggccaagttgcttttccacactgagcctttgactccttatttgcagtatgaagaaaacaccattctcagggagacattacgaacatcagttgttccctttcctccttttcaacaaacacatatccactgcccccttcttgggaaaaggtgggagaaaaccagactgagtgtgtcttaaaactaggggttcaagtttctgctctgtccttgacccaccaaggcagtgtttaagaacctctggaaaccttctccacactttatccctcccaaattctctgaatacctttgggtccttcctactcatcaaggggaaaagtaaatatgtcttagatatgttttagatctgtgtccccacccgaatctcttcaactgtaatcctcagtgttggaggtggggcctagtgggaagtgattggattctggggacggatccttcatgaatggtttagcaccatccccttggtgctgttctagggatagcgagttcttacaagatctggttgtttaaaagtatgcaccacctcctcctttgctctctcttgctcctactcctgccgtgtgagacgtcatgctccctctttgccttccaccatgattggaagcttctagaggactcctcagaagcagaagctgctatatttcctgtaaagcatgcagaactgtaagacaattaaacctcttttatttataaattacccagcctttggggtacttctttatatccatttgaggacagactaatgcagtctttgagtcaaactgctgtcatcagaaataaagagtttgatatgcttccccaccacgacagtctagagccgggcgtaggcagcgaaaaaggcttgtgaggcaagacgccccttgcaggagcaaagggacccggtgttcatttcggctggtgaggagagttactaaactaccacccactgactcagggagaactagccccaggtttatgtagaagaggcagccttgacaaggtgaagtgatggtgactggctggctccaaaaatctctctccagtcatcctgccttagatgactggaactccacccttaatccttccagttaagccttcgaaggcctccattagcagtgtaaatgtttctcttgggaggaataataaaatgtaattgaagtaaacaaacatttactgagtttgcttcaaaccaggcacttgtgagccatggcagggtgtccaaggatgaataagatgctatcctgtcctccaggagcatgtagatcattagaagcactgagatgtatgccaaattacttaaaacgagagagaaaattcaaaagaagataaaataagaagaaagttccataattgttctctcatctatatattttatcagagctggatgataggatttatcaccttggggaatttccattaacatggctgaaaagtttgtactttatttggaatataatagatagctatggatattttctgggtgaaggggagggagtggcatattttttaaaatagtactttacaaagatcaatctgacaactctgtagaagatggataagaagaatcaaggcaagaatcaggagaaaaacatgagacactaatgtgaaaggttttagagaacgagaaacaacaggatgtgagaggatatagcaggagaaggtgggctctgaaaaagatgaagggatccatttatgtttttactccacagtacttacttcaggcaaggcaccgtgctggaatctgaaaatacaatagaagggttctaccttccttgagcttagagttgagtgtggtggtcacatagtaatcgagcatcataaaaacaaacgtataactcacaaagcatgataagttttctggagaaagagatcacaggatgctataaaagaatgatgaccaggccaggcatggtagctcatgcctgtaatcccagcactttgggaggccaaggtgggcaaatcacgaggtcaagagatcaagaccatcctggccgacatggtgaaaccctgtctctactaaaaatacaaaaattagctgggggtggtgttgtgcgcctgcagtcccagctactcgggaggctgaggcaggagaatcacttgaacccaggaggtggaggttgcagtgagctgagatcacaccactgcactccagcctggcaacagagcaagactcaaaaaaaaaaaaaaaaaagataacctgctctggtcaggggtggggctgctgggtacatcttctttgactgaagtgatatatgatgtgggtctaaaggataggtaagcatgaactaggcaaatgaggtaccacttcaccccactagggtaaagacagacattagcaagtgttggtgaggatctggagcaagtggaaacctagtagctgatggaaaggtaacatggtgcagttactttgaaaaaccacttggcagttcctcaaaaacttaaacagaattaccatatacccagcagttccattcttaggtatatacccaaggaaaataaaaacctatgtccatgcaaaacttgtacacaaatgtttatagaggcattattcacgataaccaaaaagtggaagcaatccaaatgtccatcaacagatgcatggataaataaaatgtagtctatccatacagttgataaaaagaaataaagtgctgatagatgtttcaatatggatgaactttgaaaacatttctaggtgaaagaaggtcacaaaagaccacatattgtatgatttcacttatatgaaatgtccagaataggaaaatttgaagagacagaaaatagattggtggttacagcatggggaaaagaggagtgactgctaatggttgtggggtttctttggaggtcatgaaatggtctggaagtggataatggtgatagtggcacaagtgatatggcttggatatttgcctcatccaatatgagatacattccaacatgtatctcatgttgaaatacaacccccagtgttggaggtggggcctggtgggaggtcacagaatcatgggggtggatttctcatgaatggtttagtgccatccacttggtaccaccctcaagatagtgacggagttcttgtgagatatgatcacttaaaagtgtgtggcacctccccattttctctcttgctcctgcttttgccatattaagaagcctgctcttgctttgccttccaccatgagcaaaagctccctgagacctccccagaagcagatgccaccatgcttcctgtacagcctgcagaaccataagccaattaaacctcttttcttataaattacccagtctccagtatttctttatagcaatgtgtgaacagactaatacaacaagttcataattatatgaaaaaccactaaattttacacctttaatagggtgaattttatggtatgtgaattatatcttaagtaaaaagtaaattttaagaaaagaatgaatgaggtagagagggtaaaaataaggatagtgttctggtcacaagaaagtatatgtaaatgaccaagggagagaagatatggttcacagggagaatagaggtcaaggtcaatgtggctggagtgctgggagcaagagagagtgatagcacttaagtctagagctataggcagggcagatcatgagtaccctttaggcttggtttttgtcctcagaataatgggatgctgatggggaattctatgcaaggtaataacaattctattacttgggctggtcaacatgacttggagggagtcaagaaagtgtagagggtgcccagttgtaggagtccaagtgagaaaagcgaggtcaagagtgggtgatggggttggcatgtgtgtgcatggagggaacagagtatgactaggtgtggaggactagcattattctgagttcaagagccaggagggacagcaggtttgggaaaacagaacaagtctgatctgcagagacatttattttgcacctaatatgtgccagagactgaacaaggcattttatatccatgtttctttttatgctcacaacaaaccaatgaggttgattattcacactgtttaggacgggaaattaaagctcggggagactaacttgcccaaatgcacagaggtggtaggtggcagcatagggagttaaatccaggcttgatgccaaagttctttgcatctttgctctacactagaatgctcctaggccagggatggtaaatgactttcaacacacacccaactcgaatctattagtagtgactgctttggagcactgggttaagaccagttctgagctcaagcccaggcccagcaggaaaatagaccacgattaatcaggaatgaatgccgtgagcacagagagaggcagtggtggggaaagtgaaccctatttgccattcctgctgtacgagttcaaaggaggaaaacataatatctaggcaaaggactaaaaatggccacgtgtgaaccatccatatacacaatagatgactctcaaaaatattagactgagaaaagatgtcagaaacaaaagaatgaatactatatccagaaggcagaacttttttagtgaagggccagacagtaaatatattaggctttggggaccagagagtctctgtcactactcaactctgccaatatagagtaaaagcaaccgcagacaatacgtaaacaaataagcgtggctgtgttcaaataaaactatttttaaacactgaatctgaaatttcttataataattatgggtcacaaaatatcattcttcttttgattttctttctaaccatttacaaatgtaaacaccattctttgctcacaggacatacaaagaggcaatgagccatattttgctcacaggccatagtttgctgactcctgtactgtttgtatccatttatagcaggtcaaaaatagacaaaattaatagttagagatatcagaccagtgggtgcctacaaactgactgactggaaggaattactcaggaacttgctggggtgatagaaatgttctcagttacatgaatatatacatttgtcaaaactcactgaaatgtgcacttgagtgtttacatttcattgcatgcaaattcaacttcaatttaaaaagtgtgttgctttgaactgtaacacttgtgggggctgggggtggggagaatggctgcctggaagagatttcatttgatgaacttgaagaatgaattcagcctccaaagtcaggagaaatatattgaaggcgagtagaggtaaaattcaatcagggctcaaatgctaacagaaagtggaaaaaatatatatatttaacaagaagccatgaaagtataccccaacccacatgcctcattgtccaaaagctccagctcagaaataattgctttgcacaataatttggagatgcagtctgggagctgatacaaatggagccgggtgcaatttggggagatttgttacgctcagctcccttctatcaattccagctgctcagatgttcctaacctgttgcttggcatattgtaacaatggcttttatttactgcacttccattaaatgatgaaatccacgaacaggggctcacatggcagaaaatcaccatttacttctccacttatcttgtgtcagcagccaagatcttcatctcggctcctgggatctggcttcagcagccagctgcagtgctacctgggaatatcggtagagcagctcaaatatgggcggtgggactgagctgctgggcggggttgcgtgactgcaaatcatagtccttggaaggtgagcaggcagtgtggccatataggattatgctgggttgccaaagaaagagatggatgtacactcaggttttacccagaactcaaggtatcttgggaagttttgggaaagtgaggtggttgattaggagaaatattggatgggatgttgattcaaagacaaaagcgaaacccaagataaccttcacctgagtgaatcactggtccttttacagtataacacatctcggcctaaccaagccaggagatcttcactccaatgttagttttgctaccagataaatgactagagatgtgatacgagtcccttcccacctctgcactttgctctcccttctgtgaaaagaagttaaactgagtaatctatttcagctctaatgttcttttaatccaaccttggttctcccactaacttgataagtaactctcagcaagtcatttcctatgggccatggcttccacatgatacactgagagggttgactgtgacaatcttgaaaggccctcccaggtttagagctctctgatctcatctgctaagactcagaacatttatctcgttgattttgtcaaattgtactttggggttagagttgagtatacatcattcttcccaatcctacttcaatccctagcaaagggaatgggtggatagatgggtgaatggatgttggatgaaggggtggaagggaggataggtggatggcaaatagatgaatcagtggtaggatgatcagatggataaatggataaaagggagtttgggaaaactggagaacagataaatgggatgatggaaatccacaacaaatacctcagtatttcctttcctgtccatagttcagttccagtgtactgagtacccataatgatgaactccactatatatagtatcgaagtttttgatgctttctggattcttcacttcaggaaaaaaagaatcataacattctttttatttcaaagtatgcacatgaattataagtacacatcatgcctattaatatattaactgtgaaaggaacataagggaatatgcctcgaactcctggcctcaagtgatcttcccacctcagtctcccacagtggtaggattataggcataaaccactgtgcccagccataagggaatagattatcccttcacctactgggaaccataactcaaactcaggaaaccatacagtgttaaaaaataaaataatttttaactgtttctagagtatgtggtccacccaataatcattgaatatggattttagacagagagagatctgtgagaacaaggggaggcaaggggaggggaaggctaggtggaaaagatttcccagagaagagccttgaaagatgggaatgaaacaggcagtcaggcaagggatgagtacagacaagagtgaggggatgcaggagtaggaggataggaaacattgacaactgcttgatcaagaccatggggtggcatggttgggtaaggactgttcagctcaagcaagcatgcacaaatctctaggcttctgtgtgcccctaggaacgacagagggaagcagggaaaaggaggggaggaaagagaaaaagaaaggagcaagagagaggatatggaaagagtgataaaaagggacaaaaaggaaaaaggagagctaaactgagacaaaagaagagagagaaaggagtaaaaaattctctgcacctaggagttatatttcatgatcaaaagaggatgaagctgggggtgaatttctggtggcagcagggaatgcccaggaagctttggggccagccccaaaggggcaatggtgggggatgataatagatgaaggggatatggtaccttgccaggaaggcccagtgctcaggcaagtggggtccctggaaccctgtccctttctccactgccagctctaagttgctaaggttaccttcttaactgcctaattagagaagctgtcactctttgacaaagatcaggaggaaaggaggggaaaaaaaaaagcagacatttcatactcagacaagaagaaaataataaagccagtcccactggctttcacatagagtttcatagaaactctgccagcagtcaaagaagactatatctttatgaggaccaccctctgttactagtttggagagaactggaaatgcaccgctattcgcagttaacatggagcagctgacagcctccaggttaaatggagtggaagacatgcgagtcaggaagacatggatatgtacccattctgctgccatggtctgacaagtctcagggacctaggaacatggtgctcttcttagccagcaggagctaacctcagctgatcagccttaatacacctcaggagccaccattctagggccaacatttcagggaccaggatggaccacgagctgtctttggactgcagttctgggaaggagagctgaaaaagacatgggaggtgaggtggagctggaaaggggcaggtgcaggaagcaggaggtaagttctgtaaggtcctaggacggcaaggtcccaggtgaatgcctccctctctgagggcagagtgcatgccactctggaatgccagctcctcagccccttgggtgtcactcacccttccggactatgaagacccacatgtgctgcagcaccctccttggctaagctcctgctattttcctcctcctacacccacagagcttactactttctccctaggagaaagaagagcaacactttgtgttgtaaaagaaagcccattttcactaactccattactctatgcaagaatgggagaagcagaacagcagtgggttaggggccagtcctgccaccaacaccctctgggaccctgggaaggtcccttgacctctctaggcctcacagtctacaccctgttgatctcctggggttggctgtggattaaacaggagaataggaaagttcttcttaccaagaaaatgagcaacacaggggcttgtatctatatactattcagagattcatccccagcttctagctgagcacctggtatacagaaggtgctcagtatatcctcactgaattgaaacaataatttaagtacactatattctgtatttatttcttccttcaacaaatatctttttaatacaaaataaagacataattcctatcttcaatgagttttcagtgagtgaatgtagaaaagacaaacatcaaatagaaacaaatatataattaaaatctgtgattaagtgctgccaatagcaggaacttatatataaaacagggagactggctctaactaagaagtcagagaaggcttctctgagagagtgacattaacttagaatctgaaaaatgagcaggagtcagtcaggcaaaaaggggtagaggcaagatgtttccaggaactagaaacagcctgtgcaaaggccaagaggcagaagtgggtctgttacattagtgggaagataagatcagcagagatggaaaagcaaagaatcacagggagaatggcaggatacgaggctggagataaaaacagagcttgaaccagaagatccacaggcttcctagcatcattcccctaaggcaaatcctctttgtttctggagagaaatgcggagtcctgacttctggacgtgggttgtggcatgcagagcaggccacaagaaagtcatcacttttgccaggcacataaagattatgaaatcctaaaactacttccatgatcaccctcacctggtctttatagagcccttgatttgatgctctgttttgctgcaaaggctagagctgaaaggggccctggagatcatagagcctagtggtatctcactgtacttcacaaagctcaagaaccacttcagaaaggggaagagaaggcctacaaggaagggctttgggccccttcacccttccctcagccagagaagttcagctttgctctagtttttacagcactcttcacagtggagccatccaagattccatttgaagaaaggctttgatgacaaaatagggattttgaaaaccactaccattgtgcaaatgagaactctgaggtcctaatgagcacatgtcttgctttttctacccaacaatattttagtattgattcctagacccacctttcaaaatctacctcttctccatttatgtatatcccagacggaacatcaatccaggtatcatcttcttccctagatgagacatatatatcaggccaccctgggctaatgagactctcccaagaattctgaattccggtgaggtcatgggagtgaggaaaggatgacagacacttggatctccttcatcctagtgggagtgctctgatgagactgtgtgctggttattgctcccaagatccccagagcaagctccttcagcaattctatccttccatgagccatcccaaatagaaatatttggatatttcttaaataaacagagttggcttctattggttgcagaccaactgatagaccctgtaatctatggatggcttggttagggtgctcacagagttgggagtgtagccaagattagaagtcagagctcttcaaccacagcctgtgacggcctgggctggtgactatttgcaacctcatgttagctgggtccttaatccctagaattctgccttgtcttcccagcctctttccccagagtctcatgaagagtaaaattatatcctttctatatcctccaacagaattcacaggctatcttgcccttggggtccttctttataaatatgacatcagtcactcctcattgaccataaaataatttattcaatgtgcaaagaaacaagtacagatattatgccaggatctggatctcaagccaaacagaaacaagatgaatgtttaactaatccttactgtgctactccaatagtatgcgtgtgcctttcacttcaacctgagcaaggattaaagaaatcatttgcaatataccctgcttcagaaagcacctgtgaatgtcctgggtctacatcactcttccctttgctcacaatccaagcaggttaatttcctatatgaaagaagctgcaaagggggtgggcaagaggggagaaagggcttttggtttttcttctttaagcctattgactagagctgcttccaacagtagcagaagttgctcccaaggcatttgaaggagatgggaacacacaaacctaattgcattacactgcagcttgaccaagcgatcactaacttgattgcagagaaaggaaatgaaaatgacagagacaaattcaactcaaccgttctcttacttaaactcaggactcaggccaccagctggaaggcaaagggaatagaggcaaatgctcatggataattgaggaaattatttctgtggtctgtagcccttttgaaggagtggaagtagggtatgggcaccctttgtcttacctacctccagccatttagctcttccccagtggtctactcagacttgacactatggaggcaggaagaaggaccatattcgacactggtatctatccatttatttgctccttcactcattcattcatccagtgaacatgtactgagtactaattgtgaaccaaatgcttggagaagcactaggtatgcggtattgaaaaaaagagacaaagtccctgtccttgaaaagtttagtctggaggggcccacagacaattaacatgaacagatacccaaatgcaatgtggctactgagtgacaaaaaaaaaaaaagaacagggtgttgtgagaaagacagtgtattcgggggtaggtgaacatggactctaattaggatggaatggccagggaggccctctggggtctctggaaagcaaaagaaatgcaccatgagtgaaggtggaaccaggccaagccttgacagcagtggctctcaacccaggttggcactttggaatcacctaagccactgggagagattacaaacaaaaacaagagaaaacagcaatgcttgggaacaaccctcagttattacaatttagcctagggtagggcccagatcctgagatatatacagatattttttaaattaatagactttattagttttaggtttagagaaaaattgatgagaaagtacagagaattccaatatcctaactctcccctccacaaacagtcgtccctattatttacatcttgtgttagtgtggcccatttgttataattgatgagccaatattaactcactgttattaactacagtccatggtttacattagggttcagtctttgtagtgtacattctatgggtttgacaaatatccagtaacagatgttcatcattcctgtatcatacagaatcgtttcactgctctaagaatcttctgtgctctgaccctgctcatctttccctccctactagtcctgacaactgatctttttcttgtctccatagtcttgccttttccagaatgtcatatagttgaaatcatatagtatgtggccttttcagattggtgtctttcacttagcaatatgcttttaaggctcctccatgtctttttgctgcttgatattaatagctcatctatttttatttctgaaaaatatcccattgtctggatgtactccagtttgtttatccactcacctcacaacagacatgttggtttcctccacattttgacaattatgaataaagctgctataaacattcatggtggacatgagttttcaactcatttgggtatatacccaggagtgcaattactggatcccatggtaagagtatgctttgttttacaagaaactgccaaactgttttacccctagttacactgatttaattggcctaaggtagatcccaggtcctggtatttttaaaagcttcccaagtataattggtcctccatatccataggctttgcatccatagatttacccaaccatagatggaaactcacagaaatggagggtggactggactaattttctatctgaggttagttgacttggaggatagggaaccctaggaatctgaggggccaactgtaaggatacggagggccaactgtattctaagggacagctaaagctgaatatcttgtaggccttgattaggaaccatgtatttcattataagcacaatgggaagtcatcatgaatttaagtatgagtccattttcatgctgctgataaagacatacccaagactgggcaatttacaaaagaaagaggtttattggatttacagttccacatggctggtgaggcctcacagttatgtcagacggcaaggaggagcaagtcacatcttatgtggatggcagcaggcaaaaacagcttgtgcagagaaactctcattttttaaaagccatcaaatcttgtgagaccaattcactatcatgagaacagcatgggaaagacctgcttccatgattcaatcatctcctactgggtccctcacaacacgtgggaattatgggagctacaagatgagatttgggtggggacacagagccaaaccatatcatttcgcccctggcccctcccaaatctcatcttgtaagcacatttcaaaaccattcatgccttcccaacagtcccccaaagtctcaactcatttcagcattaactcaaaagtccacagtccaaagtctcatctgagacaaggcaagtcccttccacctttgagcctgtaaaatcaaaagcaagttagttacttcctagatacaataggggcacaggcactggttaaatacagccattccaaatgggagaaattggccaaaacaaaggggatacaggccccatgcaagtctgaaatccggcagaatagtcaaatcttaaatctccaaaatgatctcctttgactccatatctcacatctgggttatgctgatacaagatgtaggttcccatagtcttgggcattcattataagcacaacgggaagtcatgagttgaagcagagaagaggcatgatttgatgtacatgtttataaagtcattctggcagcatgtgagaatggattgggaaggcctgacgggggattaagagcaagacagaatctgagagaccaattaggaaactattgaattataggtcagagttgttagtaacttatagcaaggtagagatggaaagaaatacatggattcaaaagctacattgagagaaaaatcaataagctttgatcataggttaaacattgaaatgaggggaaacaaagggagaaatccaaggattacaagagatacttctaatccttctctggaagcaaatttaaatctaccctgcagataggcacaaaggttactagcttattttcttttctgtcatggtcttcttttctctttcttctttgttttgtactgtttgtttgtttgttttgtttttgaagtaagagctcctcttaataccgattactattttaagggattactaaactcttacaacctaattgggcataggcctttaaggtcaaactcaatctcctttgcccacatcagaaggctacatgatattttagggatatgttagcttagctcaaatgcttttcattgtcagttacaaccaagagttgaaattttagaagggatagtctcttaagagagtttatcagtcttggaagttttcttctgaaactacccagcagatgtttccaatgccctgaggaaaaaggctttaagaaagagctggtgatgaatagtgcaagagcagcagaggaggttgagaaagaggagcccaccagagttacagaaaaagagctttgcaaaacaggaataagacactcaggtctctaccagctgctctcaaaaacccacctcacattaaaaatcaaggtcatggacaaattggcacaagatggaccaagtggtcatggtggcctctaagttcactcaggacatttggagtcacatttggtaacaggagtagacaaagaggctacctgtcaggaatgtggaggttctgacctcacatgaaagctagagctgctccctgaaaggccagcccctcctcagccaagaatctcacttctactctctccttagctgcaaataccatactggaatgtctgaccctgagcagaaggagccagctttaagctgcagatggcgccacgctggtcaacaagggactttggctggtttctctggttagggtaggtggacaggaaagacttgtgctcagagattctaaagagaacttgagattgttggggacagagagacagagactgagagaaagtgatggaaagacagacacacaaacacacacacagatgtagagaaagaggagaaaagagacattaaaagtaaatagaaagcgagagaaaaaaacactaaagacagaaaagagaagaaatttaaaaagtggaaatggaaaggaaactgaggaaagcaaggaatgagacaaggatggggaggagaaaagagaggagagcctcttgcattccattctcgtgccatcactcacacgggacagttttcaggagttctctctggaagaaacactcataaatcttccataaaacaatgatgaaagaaagctcaaacctgtgcattcatgtcagacagttccatccgctcctgtctcgcagggactgagagctcctgagaccctcttgctaaggcctaggaatgggcaggctctgaggtggaatgggcaggctctggggctggataagcagactctggggtgcagtggggagactctagggtagaatgggcaggctctggtatgaaatgggcaagctctgggatatggaggaggaggaggagatgggaagggaagggatggctgagaacaggcccatcaagggtccagaattcctactggtaagtgtgattaataggattcatctaggacatcctggactataagatgcaccagactttgcgaatgcaagcttatgatgcaatatttgtattagcaacccttggtgtcttttcaaaataaattgccttaaacttgcattttcaaagtggatctctttggggttactggttacagtcctgtcatgaaagtcagtgctaccaacattaattggtagcacctattcaataacagattctgtaccaggcaacaggagacagaaaaggcaagagtccttccatcccctcaaggctttcataggcagtgctatccaacataaatttctgcaatactggacacgttctatgtctatgttattcaatgtagtagccaagagtcacatgtggctattacttaaatttataaaaattaagtaaaatttaaaattagttccccagtgatcctaggcacacttcatatgctcaatagccacatatggctagtggccactatattggattttgcaggcagaggatgagataagagagagacatcaatatatcaatataagggaggaggcctaagaaagataaataaagtgtcctgaataaagttaatcaaagataaataaggcaaagagggaaagcgggaggagaaataaggaatgaatgtttctgtgaggaaagtagcttatacgaaacaggtaagttccaccagcagaaattcaggagaacaaggttgtccctgacagaggacacagctcgagcaaagtcacagaaatgggaaagtaaagcttattttccggacagtaaaaaccccagtttggctgaagtgtaggcaaaggaactgtgagagagacaagcaatagaggcgggttgggtccttatgcagaggactcagctgctagggaatttactcttaatcctgtaaagcagtggggagccactgaggattccacatgagagaaagacaacctttgggaatgattcttcaagtatctacttgaagaaagaaactgcagcagtagaaactgccaagagactgggagagtgatgagggtggtggaaacgaggaaagagcatgggggaaatgaggaaggaagagctgctactggattacaagacagaaagctgtatgggacccttatttctcccacaacaagaatggcatctaaaagtctaactatcactgtgaaaggcagatccctgaagtcatttcctgagccaatgtcttttcagaggcagaatcatccaagaaaggagtgctttctcataatcatttgtcagcccattaacctatatagcaggactccttccccaaatgccgcccccactgtgtcccctcataagccactggggcagggtgcctgagaattggatagaagaaaggaaacacagaagaaaggaaaatgagatggggagaagaggtctttaaaaaaacatgctggggaagtcaaaacaaattcccagccattcctgctggagattttatggggcgagacatccccaaaataggttttgaattatactctgcacctcataaaacacaggaactcttggcagcccgctcacacacactgccctcttgttacctgcccaaccgtccctaaaggtaggcatgctgggaaacccagtggagacaaaagaactcaaggctggtgttctgagttctgtgttcataagtagcctcactcccttgacgtcaggaaatgtagtagccttctcccagcctttgcctccctctgtgcaataagaaagctggatgtggccagagggccctggagttgtgaatttagataatctggggaattggggtgcaaatacgcagagttacacagaacccccatgaaaccatacatgtacaaggtgagggcaaaaaggacttgaaagagaatgcctgttgaggtgtggtcccagatggaaaaaatatttgttaatgtttaattattttctaaaaatattgaaagctactgctgaacaacaacaagaagaatctatagaacattcctggtctttgggaagtcagtgtgatctgggaatttaacagcagctctaacatgctcggcaactttactattggaaccacagttttctcatctataaaataggggatagtgtggggtgcctccctaagaaggccaccccaaagcatgaggacatcaatggcaattgctgaggaatcctaggaagggttatgaactacaacagtcaggagttcctggctcatctctgggattctgtttcctcctctttaaatcagaattttggacaaatgatatctaaagcctcagccactaaaactgctatgacttaatgcctctgtcaacctgaaatgtatatatttcaaaagcttacagctggccttctttccactgactgccagatgagcctgcgtttcatgttatctctgtagaacatttcgggcctccccagctatgaatgcttacactgctaaagtgctgcctctccagcactcaggactttgccacccgttaagttgtattttacaggaagccaatttgttttccagacctgcttatgctcattatatttcttataattacaaaacttaaagaaatagtttactttttattttttatttttgtgtgtatattgtaggtgcatatatttatggggtacatgagatgttttgtgttgttgttgttatgagacagagtctcactctgtctcccaggctagagtgcagtggcctgatcttggctcactgcaaactccgcttcctgggttcaagtgattcttctgccttagcttcctgagttgctgggattacaggtatgcaccaccatgcccagctaatttttgtatttttagtagaaacagagtttccccatgttggcaaagctggtctcaagctcctgacctcaagtgatctgcccgtcttggtctcccaaagtgctgggattacaggcgtgagccaccacacccagctatatgagatattttgatacaggcatgcaatgtgaaaaaagcacatcatggagaatggggtatccatccactcaagcttttttttttttttttttgagggggagtctcgctttgtcacccaggctagagtgtagcggcccaatctaagctcactgcaacctctgcatctcagattcaagcaattctcctgcttcagcctcccaagtagctgggattacaggcatgcaccaccatgcctggctaattttttgtatttttaatagagacggtgtttcaccatgctggccaggttgttctccaactcccaaagtgctgggattcaagcgtgagccacagcgcctggcccatcccctcaagcatttatcctttgagttacaaacaatccaattacactctttatttaaaaatgtacaaaacttaatgaaatattctgcaaattaaaaatttatgaacatccaagaaagtggtttctaggaggactaagttgattatactatttaaaaaaaacaaagaaagtcacttaaatattgctgttgaattaggtcaggtgcgacaactataaaaatttagaaaggaatcataaaactctagaaaaattacttggcaagcatctttaggtcctcagtctcctttaatgaaaccaacactggagatcatatctggtgtattatgagcatggtttatggaagacagatggcatggaactccaatcagctgatccagcctccaagaggcagccttgggcctacatctaataattggcaaatgtatgcacatttacgtattttaagttaaaatgaaatgtttacggtgcgtctattactttttatgattctccactttaatggactttttctactaactgaccaactgccagtctaaatggcttcaaaaacaaggatttctagggcaaggaattaaaatgaaatgtagttagccctcccctgaatagtttgtctccccacacaaatgagaagtttaacgaagaagaagagaagcactgatttagcaatcatgtcaaatgccatgccagagacacccacccccgacaggttgtaataactagtccctttctagcttctcctttgctgagttcagtttcttctacttctcctgacagaagaatcatcatattccacactctctgtgtctcatatgtatctgcatgtatgtatgtatttgtgtacatgtacgaatgtttctgttacatattatgtatatgtgtgtgtgtgtgcatctttatgtgtaaatcaagcaaaggaaaataaaaaaagaaaattccctaagacctacaggaaatcttgagatagtttcaggggcctgaacattctaggggtggtttgtaaagctggcttaatgttaattataagacggacagtaagattccttcaatcacactaccaccaaaaaatgtggaaggaacattaaccatctcctttccaatatattgtacatggagaatggaggccgatgctgtggtttggacatagtgccatccttctaaaatgttttttaaatgtctaaatgcatgttttgttcagatgaaattgaagctccaatgttacaggcagctaagagtggagcacctctgtaacagaaatccagagcaactcatactcccctgatctatcatggaggccagctatagaaaccagtgccctaatgaaaagacaattttatcaatatctctgtgccgcctgcaagaaacttcagaatgaccttggacaaatctcttcccctctttggcaccaaaggtggctattcacaaacatatctattccacattcccataagcattccagcaaactgtttgtcatggccacctttgaggaatgtgtttgggtggaggagagactttcaggttttcctttacaatatctccgaattgcattaatgtgttacaacaaccttgtattctttctgttaatattttttgagatggagtcttgctctgccacccaagctggaatgcagtggcacgatcttggctcactgcagcctccgcctcccgggttcaagcaattctcctacctcagcctcccgagtagctgggactacagacatgcgctgccacatccagctaattttttgtatttttagtagagatggggtttcaccacattggccaggatggtcttgatctcctgaacaccttgtgatctgcccacctcggcctcccaaagtgctgggattacaggcgtgagccaccgcgcctgacccaaaatgtaaaattgaggttggaaatacaataaacacacgtgtactctctgctggagttacagatattaaagagaaatgatgtttaacttagaaagcttacatactaacaagaaaggccgacatgcaatcaacaatatttctatgaaaatactgactgcactgaatatacgaaatgcttgggaaataactgttttggggggagccaggaaagtcatcttagaaggagtgagggaatattcacgctggatcttaaaagatggtagttatgaggcagaaaagatatttttaaaatatataatattaaagataatctgacatttaagtgagcaaaatttgaattttagaggactatcttcgtctctgtgcttgggtcgatcaacattttccaagtattgaaccagagatgaatttagacggcacatgagtgttttaacttcgatagagacatacttacttttgcaggctatcttccatttactgaaagttattttggtgtttcattcatgacagtgatacaaagtttcctttttaaaataaatacagctaatcccattactactgaccttatgcaataagggtctatgagcaccctgcttttctataccactagagatccagcacagggtctgggatggaaggaccactgaagaattactaaaaggtcttaacaccaggcagagatgccaaggttttcgggttgaattggtttagattaggaaatgggaataaaattcatcccctatgctaatcccaattgactggaagtgattgatgaggcattgcattgagaaagaatctcaggctatcattaaatgattgattagcaatgtctgtcatgaatacagaagtggacagtggcagtatggccaaacataatttccactgattattcatttattcattcaacaaatatttattgagtatctactatatgatggacacatctgtaggcacatgggattctgcagcaaaccagactggatgatttctcctctctcttggagtagcctatgcagcccaatcttcccctgctttcctgaaagagacttggctcttacaatattaatcttccctgaggtcaaaaaaggactgccatttatttaaggtcacacaacaaatcaatggcagaaacaggactagactccaggcactacctccaaattcaacacagttgtgtacttaccagacttgaaaaacctgtttggttttcctagctctgtagctgccctttctcagccatcagtctttccacctgctgtccttttgtggggaggacagaacgtctgttccctcctggaagcagggaggcaagtgagtgggggcgattccctagaggcttctgtggtttggagagatggattaaagaggtcaggacaataaaagagagagagaaaagaggggagggagggacagtaggaaccctgccattggcagaccagtaattggttactttgggcagtccccctccctggggaaggctagagagaaagtaattgaagaagattccctgataaattagtgcaagactgggcttgaaaactctagtcgcacctgggttcagagctgagtgtttgatcttcagaggccccagaaaggatagagaaggaaaggagaaagctttaactgtaactccagcctcagaagttcccagagggaacccttctctccctcctgggctcctaggatcacttagtttaatctcatcacattagagatgagggaaagcctgaaaagaggaagagacttgaccacagacacccagcagaactgggaccaaaacccacgattcctagttctagtcctctccaccatattacactgcctctgggttccatgagatctttaaccacatgacttgcttcgagtgatcctaagctctctccagctgcaaaagaggtagggagggggctggtattagggattaaggtacaggcttatttacttttgtttatttaacgagcacataggtagcatgtactaagtgccgggtactgctgaacatactttataaactttagctcctggaatcctcctcctaataaaaaacagaacaacctgatgaggtagtgatccatcagaagtggtgttcacaaactatcaccctgatttctgcccattttgtcaggaaatatctactcagaacctactatgtgatgttcctcagctacgtagctgagggagcaaaatgatgaacaagacacactccctgcctccaaatacctgtcaggtaaaggcttttaaaaataattgagatagctgagagtgtggtgtataagggtgctactttggtccgggaagactacttggaggaggtaatatttgagttttgtgagcaagggaggaaatggtagaaggcaactcagagaaaaaggcaaattatttaggattttgcagacactgaaaaagaatgaggattttatcctaaaaacaatgagaaacaattgcaggtcgtaaacaggggagtggcaaaatataatttattttttggaagacatcactctggctactgtgtagagcagaggttggcaaacgttttctgtaaagggccagttaataaatattttaagctttgcaggctagacactctctattgccactgcttgactttgtcattatagaccataagcagccacaggcaacacataaacaaaggagtgtggctgtgttccagtacatttttatttataggtactgacatctgaatttcatatgattgtcacatgtcaacaaatattattcttctcttgactttttgtcaactatttttaaaaagttaatagtcttatgagctgaacaaacaaacaaacaaacaagcaattgtttagatttggcccatgggctatatatagtatggcataaagaaaggacagagaagggagaggcagcaggaagaccggttaggaggctgatatgggaaaggatggcagcttggatgaaggtgatgccagtggaaactatgaaaagttaattctgaaaatcttttcctgttgttgtttttttgagacagagtcttgttctgtcacccaggctggagtgcagtggcacgatttcagctcactgcaatctccacctcccaggttcaagagattctcctgccccggcctcctctgtagctgggattacaggcacctgccaccacacctggataatttttgtgtttttagtagagatggggtttcaccatgttggccaggctggtctcaaactcctgacctaaagtgatctgcctgcctccgcctccaaagagctgggattacaggcgtgagccactgcaccctgcctgaaaatcatttaagaagcaaaaccatcagggttagctgactgaaaggatgagaggcaaggaaaacgatgaagaatgactgcttagcttgaaaaactaggctaatagtttgatttcctgagatgggaagatgtgggtagagcaggtttagggggcaaatcacacatcaatagtgtgatcccagacaagaaggagagaaacacaggtttcctacgggcttctgaataaaataaaggacgctcagttcactttgaatttcagatagtcagcgagacatttttagtataagtatgtccaaaatactgcatggaacatacttatactaaacaagtattcattatttatctgaaatttaaatttaagttggcatcatgtatttttatttgctaaacagagcaaccctacatggagtggggtggggtggtggtggtggtgtgatggagggtatataggtctccaggaaaagaaaacctaagcccaagaggagaaagagaaggctccttagagatgacaccccttagagcagatgctagagctaagtctaggagctggccaggtgaacgaggaatacaaaaacaatctaaacagagagaagagaataagcatgttaccctcagacatttgcaagtaattaatgaggctagagcctcgagggaggaaaggaacattggaggatgaggctgaagagcttctaacagggcttcacttcacagaggttttctaggtaaaggccagggtgtcaatacacttgctgaagttcagattcccaggcctctccccaggagcctcagcaggtctggccttgagagcctgaggtctaccgtgattctgatgatcagctaacttgaggaaagcctgggttaaataatctgggaactcttccacctacaaatcctgggagccaaacaagttgctgctggctgtaaaagtcttgaaaagagtaattcagataatcagaggaaaggaagcattgaataagtgtgcagcctcccatggggaccctctagaatggagctctgtccatttggaggacaatagggaatccagaatgtttgtcaaaggaccagtcctgctcctgaatagtcaccctgtctggcacctggctctaatttggtgctatctcccagctctgtgcaagtagaccagacgtcttcctgtgccttcccccgatgccccacccccttccctcctccgccctcagccaccactgaaatgattcccccaaatgcagctattactgtgactggaaatctctttactgctgattctgctaatggaaatgttccttcccttttcggctgcttgcaaagccactcgtgacttccctgggtgcatgagagcaaggctttgtcagccagccaccaccagaagggagaggattctgccccgcctgctcccacaacacccacctgccttagactcagtctctaagagctcttctgtcccaactgtcctcaaacaaccccggaattccctgcttcccccagcttcccccagctccaagagaatgagcagacatcaatggtcaatttcatccttttttgccttgctggggaggaggggaggtggagagaggaggcataagaggagcatgagggagtggaaagagggggaggggaaaggaaatttacattcattattgattcatacctccacctccttccaaaaaaaggattccaggtggcgaagaggcacagagcccaagctgtgtgccagatgctgcgctaggtgctttgcacacactatctccataaggatcacacagcttagtgtaagtaaaaagttagcacagtgcccagtgctgactaaaatgtggttatggagggctctccaaaattaagtgactattatgttttcttcatgttattgatgggtaagcagaggctcagagaagtggcatacataaatctaaagctaggaattagcacatctgggatttgatcccagggcttttggtcctcagacctagcaaaagtctcactctagcacactgccaccatcagaggacctgagctagagacttggttgtgctgtggattagctgcaggaccttggaaaatgtatttgtcttcgctacatagatgaaggagttgggttggatctcaaaggcatcattttacctcattctaataatctagaaggatacactatatatttggatttatatagcattataatatattacgtatgtgtgtgtatgtatgtataatatagatcccacattcaaggaggaaacacgaaaactgcacaatgatgctaaggagtactgagtggaaaaatttgacaaggttgagcaggagtgagaagcaagttcacctagccagatagcggctacatctcagactccagacaccctgatcatttcccaaaaaaggacatagagcttatacaaatttctcagaggacaagatcactgatcccctagtaaacacttggcagagcatgaggtgacaactctctaagagttgggaggaaggaagaaaagggggaaaaaaaagaaggaaaggggatggggaagaaaggagggaaggtggaaagaatagagggagggaaggagagaggaaaccaagaaggcacagaaacataggagtttgcttgtcaagtgggtccaggagtaacaagaggcatctggagagtatgagacaaggcctagatgctgtcttggcaaagcagcaaggagcaagcaaaggggcctggggagctgctaagtcagctcctggcagcacagaacaaggtgctcagtcccttgggcctgtgaggctgtcacacctgaagttcctatataagaaacgcctgcagcttcttggtcatgagaagaggatgacataagaagtaaaaaagtctagagatgaaaagttgagagcatctcttgttctatgcagcatgcaaggcagacagaacatagactatggaaccaggcagacctggatttggactgagcttagctgtataatagctgtgtgatcttgggtaggttccttcactcctctgagcctcagaactcaccctataacatgggatgagctacatctgtccttcagcactgtagaaagaatagataacaaatgtaccatcatggcacctgggacatagtacatgttacataaaatggtcacggttttcatagcctatcctatgtaggatgataaagtccagttacattacaactctggaattccaactcctcctgtccccagtttcccagctgcccttccctaagatggaaggaaaacacataggggtcagtagatctgggatctggcatctgctttaccacaggcttggtgaccttgatttccccatctttatatagaagtgtttcagttagataatgtcctaaatttttccatttctgatatttgataatcctggaaccatggtgtatcatttccctgaaacttgtattgtctcttcgtttgctacaatgcaaagtttctaatcatttacctggtttccaagctgctcaagacagagtcttctccaaacacaatgatctttcctctaatcacattgttctcattagccatcctgcaatcaccccaaaataatcaggagacaggagaaggtagcagcaatggctatgggtgcttagaagagggaaggctctgtgggatggatagtgtttaggctcactcttaacagggtagtgcaaattcagcccatctcaagttttgtctactgtggattctgggatgacacttagcaaacacagagttctagttctctaagatctcctgtacacctacaatgtgccaagtaaagggtgagtcaccacagccccagagatgaaggaggtacattagctgctcacagggtacataggcaaacagcgtgagacacatgaggaaacacacagcgtaaattctggtctcactctgctccaagccaccattacttttcatcagtagagactccttcaggctttcctgcacccatcgttggtcctgtacagagcagcgtagggaattcttttgaaacataagtcagaccttggcactgttttgcttaaaattctacagagctcttgatttcactcagagtcaaagcccaaatcctgacagtagtctgtacagccctacatgactgttcttttcttctctgacgtcttgtcctgccacccccctcctccaccaccacttgttcactgcattccagccacaccgaccttcatgctgtcccttgaaaggtccaggtgtgctcctaagctagataatcagctaggattatctagctaggagctgttctccgcctggaatgtgcttttcctagatgctgcttggctaactccttccccttcttttagcctttgttccaatctcacattctcaataagctcttctcattctatcctatttaatattaaaacccgtctccttatctcagaactctcgattctcttttcccttagttttttcccttttccatagaatttttcatcttctcacatactacataacttatttacttattatgtctgttgtcattgtcccctaacacacacacacacacacacacacacacacacacacacacacaacacagagggataaaagctctctgaatgcagagatctttgtcttttgttctctgatgtatcctaggcacatagaacagtgactctcacatcactggtgctcagtgattcaaagggcctggctatgattatagcagtctttattgatagtgggcaccaaggctcagagtgttcaactctggtgcagaggggtcagaaaaggcttcaaaaataagttgacacctgaattcggtcttgaaaagcaagaaggaatttccccaggggatggtgaggtagaggtgccaaataagaaggaagggttcttagtaaaggacaatctggcagagtgtgatcagggaccttgtactactacaatagggagagggaaattcaacaccttcagaacaatggggaagcagtgaagtgctttacaagaggatggccattatcagatttgggcttttaataaaatcactttgtctgcaagtacggaggatggattagaggggataagactagaggtagacagatcagtgcgttgactgttgtaattgtagtagagagaagtgttgaggcctgaccttgacagtgactgcagtgctggggatgaagaagtagtttcccttcatagtttgtaacctacaacatgcttgtcaaatttcaactcacagacttggatgcttacatattccagtatgctagtaagaaagctacacatatttcagttttgaatcttgcattgtgtagtcatcacccactccttttccattcaaaagggagttcttttggggggctattgtccaaaagagctatagtcagtagagaaaagccagtgaaaggagagaacaagtgctagaaaatagaacaactctcattgagcattgctgcctgcctctttctgggggcagagaggctgtctgctccattgcaaggaaagaaaaaccagctctctctctctcactatagttaatcttttgttgccactagctggtcagtatgagaacgtgggagagtatcagctctggaaaggaagcctcctctaatgctgctccaccccaaggttaaacccgactctttttttcctttcctgaaaagagcagatttcctccacccacccccaaaggcagctagggtgagaggcagtgaggcttccttctgccccagaacaaaacccatcagcccaggtgcttaggatagattggagccaatcagttggatactcaggcaggaaaaccaattcaatttccctaaggagatttttccttgtagattttttttttttggcagggggagaggaaagagtgtccccctttatgatgctgaactaacttgtagaatctgtgatatgtttaaacccaatgccttctgtgagaggcccagcaatgtgatagaaagaggcagtgtgggcttcaagacaattgggcttaaatttggactgtagggtaggtttcttcccttatctaggcctcagtgttaccatataaaatagaggggttgaattcaatgccttgtgagtctgtgatgctgggagcccatcaaagtcgacggttgtggtgacagttttccagacttcattcaagaggtcgctgtcagtctatcctcctctccccacatcacacatattcacaatggcctatggcaaacaaggcttagtgtataacaaagcaaggaggtgagaagcaggaggccttgccagccaaaggcctagtcaatcctcctgctgcacctgctacaaattaaaatcacagagtaattttgcagactgaggtcccagttcaggaaaatgatcaagccatgggtcatgccaaagcttgcagatctgcctaggttggtatcactgaccccccaagaaacagcaaatctggtccaccttgaccaaatctaagccttgctaatggttgaaatgagctctcccctctctctgccctacactgtctcaataacatagtactttctgaaggaagacaacgtatttcactctgccctgagcattaaataaatttcatcggctttgagatggaaagaagtggggtagggtatggagtgagggaagtgagtggaaaagagtagaagaattagatcagaggccactaaacaccacctcccccaagacccttgtttataatgtcccagaaacctagaccatcacaccaagatgggaacttgaagtttgactgctaaccaaatatctcaattagcagtaaaggacttggtgaccaaatgaagaaataacatacattgttttaatcctatctttctctcaagaaatcaaattttcttgcttctccatcccagaatctttctctcacacataagaaaaaaaagtggaattgatgctaatgaacattctgtggtcagaaacccctagagaagacacagctcatgactatttataaggattttttcctccctccaaaaaaattaccatctgctttgattcagcaaaaggaggtaaaagcaaaattgagtaagcactcattgtccacctttagaaccaaaccagaaagcaataagggtatacaacggtctgcaaggaagtgggtccattcttcgaatgtctgccaaacggaggtccagtctgtgcttgaatacctacaaggtggattgtattaccgttaggggtcagcatactgggttgttggacagctccaggggacacagcctcctgtagggctcagctctatcctctcagatctttcaagacattcgttagaatcagacaccctccccttctccaacagaaaacatactcttaatttgtgtagacttttctttagggacagggtctccccctgccacacaggctggagtgctgtggtatgggcacagctcactgaagcctcaaactcctgggcataagtgatcctcctgcttcagcctcccaagtagccaccacactcagctcattgttgacatttaaaggaagcttctccagccctctgtggctaaactcccttctcccaaccattcttctggccaggttcctggcacctcactccttcaaggaacatttgctgacctgaacaagttggcatttcaaaccgtatcttcctccttcttccaggccatcagcttcttgcataaagcagcctttgggatggtcctttgggaccccgccagctctacgcatgcaggtgtacttaacacagactaatgaatagcttttctttcttcacactccctcccccaaatacagatcacacgcctctcctgtcaggttgatatggcaaagcaaattactaaaaaatgttgacaatgagtgcttattcaattttattgctttttcctgcttttgctgaatcaaagcaggtagtaaacagtcttgcctgaccactatcaagcacagcaagaaggatgacatttccctacctgtgggcatgaaagctaaatccacaagcagaccccgggggctgcctggaggtaagtgaggactgaatgacatacaggttcaccttagaagccctgggctggcagttgttcctgctcaaattctttcttttctatcagtccttcccaccaccctcatgttaccagtaaaggaaaacagacagtacaaagcaagaggagctatcagagtcatggagtaggtcagggcacttcaagttcatagaatctttacacgaaaggattattttagagctcatctacccactcatattgcagcagaaagaattgaagctctgggggataaatgacttattcaaggtcacagtgagccaaagctgagatttccagatcctaaccagcgttaaatttctaagctgcattttagcattccacttttcctcattttgcctattaaatcctccaaggcctagttcaggttctttctggtccagaaagtgcccccagtcttctccaattctacagagatgccttccttccctgatgctacagaatgtatcatctccatcactcattggcaccaataaataaaatgccctttgacatccaagagtcatgaaactttgagctggaagggtcattggatgtcatttaactcatatttcagtttcaaacttacataggtcagctcaccaaggtagctgaagttcctttggagaaaagctcttgtctaacaatcttgatgattgttatccctctctattcagcaccataacctgcataaacttcatatttggttcagaataccagtttagcaacctacaagaatgtaggtgtctggcagaccaggattccagttccaggtctgccattgattcctggcatgactttggattacgcgtttgacctctctaaaaatacttcctcatctggcaaatgggagtaacagtagagcccactccatatatgttatgtaaattaataatacaaggcaggaagaaagctcttagcatcacattaaggattcaataactatttgctattctttgatcactttcagggagattcactttgtcaatgtcattgacttataatcagattctaaagaagaatcccaggcaaacaaactttggagatagttcacaactgaaggaaacttccatttacttaaggcaggctgaaatttgatagggagactagaaatacaaaaaggaaaggatctgcaaaaaaaaaaaaaaaaaaaaaaaagacttgcttccagtctgggcattaccaataacagaaacaaaagaggcagaatggagggagccagggttaaatatgaaggtgaccttggtgcacgcagatgggagatagtgcatgcaaaattaccttgaggtcccccactggagtttgaataaactaagaattcttctttttgtttgtccccctttaataccagggatggtttaccaccactaattctggtcccaggacccaaagtgaccagagggctttggtggacaccatcaccccctagtggtagctccacactccccactattggcagagtttggcatttaccaactttgcatgctcagctgtggcactggccatgtccgtatcccctgaactgataagctgatagtgaaagctgcccaactcgccagagacaaacgttaggcaggatgtttaaaagtctggggatgggatggggctgccttgggacactagaaagagatggccataaatgtctcatagtatcagccccaaccccacccctaccaccacccccacctcacccctcccccccccaacccccagcgggcaccaactctcatttccggccagctaggtcctcccagaactcattgtgcactctgtgtttacacacaaacagtggaagaccaacacaaataaaaatcccacgtctccctacacagctcctgctatacccagccatctggtgactacctcgctagccaaatccccgttgagagcgcctaaagctgccagcccagggcgctagggggaaaaggaggaggcaagaacccaatcccccgcatgcatccaaaaggctcagcgctgccaaggaggccagccccgtgctctccaaggggcagagggtcccaagctgccaggctcagggaccgtgcatcagaggagggggaagtctccatgtgcaggttgttgccaggagactctcaagcaacacatgggtcctgggggaatcaagacttctaattcctcgctcaggtcctcactcagcttgtcccaggctcacaggcacccatcctgtttgaaagccaaagttaaaaatggcaaagattgtcagttccaggaatcccggggcacctatacagatggttggagcaggtcctccatatcctcgaagacttgaaatgctctgtggtcctcactgccaagtcaggccatacccaaggaccgtctcatcccttcacttgaatggccgtttggggggcgggaggatttccacccctcatctctcagagtaccccggagtagagagatctaaaggatgaagggagaaggtcaggaatggaagtggtagtgaagggataccttctgtgtctctagaaagacccttccccacggggaggtggcaagagccagctgtgagcctgaggttagtccggcggcgctctaaggaacaccacctccaccctccttccctttctcggacatgggcagccccacaggtgcacgtgggaagagctactggtttgtgtgtgtctgtgtgtgtgtgcttggtgcgtcgcaccccagaagcgccgccgcggggagtccccgaggaacctgcaggacgctccgctgcctctcctcccggaacgctcggcacgctcaggttacagcctgcgagggtgggtacaggggctcgacccccgaggttcaagctcagagcgggagaaccactggcactcgctcaaatccccagaggtggtagcatgaaaggatggggagtgggtcacaaaaatacttttaacaatatcagggctaccaggagagtggagcgtagtccgctgattattctgtgggtcttttcaggcgagcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccattcctactctcatgaaaatccatctggaagggcagaacccgcaactccgaggcgagagcgagggggcggtgacggcgggtggccagtgacggtacccggagaagtgggaggctcgacctgaaactggcttaggatctgggatgctccggcccctagccagagcaccttcagtgaatggggtctccggcttccgggatggatcaagcagagctccaggtcgggactgagaggcagaggggcaggttcccactgcgggagggttggcacgcccccaggctcccgccgcgcgctctccaggacctcctcccacatgctcgtttccaaccacctgtgcgacctctgggcccctcctctaccctctgccaaccccactcggggcagccccgggcagggatccccagggcgcccccacccgtccggcatgacgcaggggctcggggttccttgggatctagcgcgtgccggcgcccagccttacccagggtgaagaagggcagctcggtgttgtccaggtcgtcctgcaccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaacc

SEQ ID NO: 268 - DNA, 261991 bp, Homo sapiens
aaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttgg

SEQ ID NO: 269 - DNA, 262039 bp, Homo sapiens
aaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagt

SEQ ID NO: 270 - DNA, 262039 bp, Homo sapiens; identical to SEQ ID NO: 269

SEQ ID NO: 271 - DNA, 262039 bp, Homo sapiens; identical to SEQ ID NO: 269

SEQ ID NO: 272 - DNA, 76420 bp, Homo sapiens
taagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagt

SEQ ID NO: 273 - DNA, 124792 bp, Homo sapiens
gaagagaaagggcagatgtaattggtccatacgcaacagttagaagactgaggctggcagagtggattacaaacacccaccactccgtgctgtccacagacaactcccttcagacagggcacaggcgggctaaaagtcaaaggatgaaaaacggcacgttacaccgacaggagtgaaaaagaaagagctggaatgcctttgttactgtcaaaacttcagagcaaagacaattacttgggtccagggtcctaatgacagatcagtccaacgagaagacacggtgatcctaaatgtgcatgcgtggagtatgtcccgttaggacaggggtgaggaacaggctgcggctgcccacacttgtaagcgccccacatttctgcacgcgtagctaacgttagagagagtctttctatacactcacatcctatgtagtaaacacagtgagcttcggctgggaaaagcggctgctccggccgaggaaatcctggtcgtgaatgaaaatgcatctctgtgggccctcacaggcccacgcagaggtgaatgaatttggctgtcttctgcatctgcatctcctggacgctcactgatctgccccagggcctggtggttgctgtcccagcttggtcctgcaagcccctctgggtggagctgctcaccccgtgctccggggctcacgcctgcagggaggcccagcctgtatcaggatcctcttcacaacctcctgaccccaccgggcggccctgcggccctccagctccaccagggcagggctaagcctctccggctggcctggcatatatgctccgagacatcacacacttggatatggcctgggctgacataagttccataagcacctgaaggctggtgcacgagggtctctggctaagccactgcacgcttaggctgtgcccttccttcctggcctatggtctcacctgctgtccctcctctccgtggtggagacacccacacaccttcgtctaagcagaccagcagttgacttggatcggaaacggcttgtgcccaagcaggcccagcaacacacgtggtccttcttcagttggttcaatccaatgctttagagaaacacgggattttagcattattaaaagatgtggatatagcaaggaatggaatacaacaacttcagactttggtgggtggaggcggaatacgtaaacctctgacagccatgaggagaccgagccctggctctcttgtgggacctgctgaccccagcagagccctgcagacaatccacagatacacggtggtcacttccatccagggagttctggcagggtttgttatgtggcaacagcaagtcaatacctcatcctagttcttcccagggcagtgctgtgcacagagaagacacaaaatatacttcgagttaatacacatttaccgagtatctgctaatttgcagatggcgtgctaaggacaagggagaggctggtgatccagatggcataattcctgccctcagggagcacagttaatcatactttgatgagttctatgaaggaaattctcagcaacacaggatgacgggtgagttaaatgctatggtgttaggacagaaagggaaataggcagtgtagaatagagaccctagagaccccaggtggagatccatgcacacgtgggaagtctgcaagtaacagaagcagcactgcagaccagtggagagacagtgaactcactggtgatactggaaaaagaaactttccacatggcataaagtaaaactgggttcctgcctaagcacgcacaccacacacacgattaggcccagctggattaaaagcgtgtgtgtgtgtgtgtgcgtgtgcacgcacacacacacacacacgcacacatacacacacactattaactttatgaccctggagtagggaaaggcttcttaagcaagtccaagacactcaacaaaggagaagattgatagattttactacacaataattaaacaccgtaaaagatactattctaaataaagagttaagacaaatggtagattgaaagaaaatatttgtaacatatatgacaaaggattaatagccttaacagatcaagaatattaattccatcagaaaaagagtaaaaatgggaagacgacatgaaaaggcaatgcacagaggaggaaggcagcaacatgttaatcagtcccccatccactcggtgcctggcacaggaggggccccgcctcccgccagcctcttcctagtgcagacatcactgctgcctaaggatgagtccatcaccatgaagacccaacgttagctccaaacagcttcatggacacagctttggagagagtgccattttaacaaaatcaaagtcctgatacaggaacatgtatttttgcagtacatcttggcagtcacagtaatggctgtctccgcatgagcatctgatgttaatgctcactctgaaccactaaaacacaaagggtgagccccgtgtgccacagccagcccccacgtaggtgagaaggctttaggatccaatcatatatgaggcccgtgtttctttctcatgcacttatgggaacagacaaaaaactatgtttagaaaagatgcattattgaagaaattttaatttaaaaaaaatcaaaagaaaaattgaacagtgcctaaatctttattttcataacctacattttttttcaaattagacagttttacactgaatgacacaaaaggaaacttaaattaccaatagtttacatgtaagcttgattccagtcttaatgaagcagaacaaaaacgaaaccctcgaggagcgaccacatgacccccgcgctgtgagctgctggcggccagcgccctcgcctcgattgtctgcagccctgtagtgggccgcgaggcacgcaagccgcaactacagctcgccagcggggcacacagacaggcatgcaccaccactacccgtcgcccggatacactgaactggttttgaagcctgaactgcagagatcctaatatagcaacgcaggacgtttacggccacccgccagtgacagccggtgatgtgatgacaggagggcctgggtgaaaatgtcaagacactcactctcagagaacgacgactccacttgaaattcatgtctggtgaaacgggaccaggtttttattcttctatttcaaaatgataagcatcatcacacgattttacaagttaaaatgccatttgtcactgctgcatctctgattctataacctgagatactgctgggggtaaaggagggtgttaacttaaaaaaaaaaaaagtatgaaagccactctcatcgctgtatgtgacacagcacagttggcatggaccgccacagcttcctattatgataactctcattttcttctgagcagaaactcttgaagtagtatcaggttttttcagacattatatagcaatctgtatttcacctttaattaaaaaggatgctataaaaatcacctccgagcaacgtttcagttcttgatgcagaagactgctgctggctaggcagtaactacagtgtattgaccggagggcagcagagccctccagtggcgactggctaatgcacgcgctgccctcctcatgcagctgttgagctcccacttcggtcgacaaagtgaaggactaagctggctctaaccacacacacacactgcgctgcaatgctcacaccttgggggaaaggacttctcattattaaaaaccaaggactcactggcggacgggcaggccttgtgttttgggaatggctgatggcgccctggcccttccgtagcgaagatgcagctcgtaggcccaggcctcgaggttgcctcccagctttctgagtattgagagtttgggtttcacagatcaattatttctgattttttttttttttttggtcagtgaactgacaactacaaaaaaaaatccccatgttctttaaaatgcatttgaaaaacactagccctgtggctatttctctgtatttgaataatggcaactgctttaaaggaaatggtcaaataggcatgttttcctctggcagggtcaatcatgcttagctgcaggtgatttaaattagattactagtcaccttcacttacgatcctgccagtttttgctctctatatactttaaaactctttcacattagatatgattagtatgcatttacatacattttaaaagagtatgaaaacatctggaggcttttaataagactttccaattcccttttgcagcaaagaggcagaatcagttcaacacaccgatgtaagagaaaaaagaaaatctcaacaaatcaaaataatattcaaaccacaacatttagtttatctacatcccgctcaacagcaacatttataatatatcaataatctgtatcagaattttctctgtagggtacctttttcatatgttctgattatttacaactgtacaagcgaagcacactccaagtgcacgtatttaatacagtattgactatttgcatttacaggattttccaacattctgaaaaaagatcaactgttgaagatctttaaggtatattacaaaaactactactagctcttgtactacagtatgcttactcagtaaaactagcgacaggagatccacgcagtaactgagtaactctgacccactcacgccaacccagggccgggctccatggactctaagctgtcttatacaaaagttaaggcaaagtcattttcaagtttaaataaaattcaagtctttaaatattggatggaaataattttttcttaaaaaaaaccctcagtcttgttaaataacattttgtggaataaagtgtatggttacatttagcaggaaatattcttattttaatgtttgctgcttagaataaagaaaaatttgaggcattttaaaacaaaataatttatatttaactttattataaacttgctaactttagtgcatccttgttcttcagaagtgcagcacttctggaagtgaatcaatgaggccctcgtcttggaggtaaaagagcaggaactttatcctccaccagccaaagagggggaaaaaccacaaacaccattctctcacgattacataactcttaaatccatgtgctgatgcagaggtacagggagatgtccacacggagctgaagatgtggactctctccaaccagagtgctggggaacacggacagaaatgtgcacagagcagggccggggccatcagctcacaggggtcaaaacaacatcatggtacaacttctggtaacatgtcagtgggcaacaaagtgtatgttttcatgtaggttctattcacaatgtgctttgaatttatattacataatagccacttgaaactggagtgagaagctggttacttgcttgcagtgcatcagaaccaaggtttctggggtggcccctgcaggttcactccgcccaggagatcaaaaaggatgcgctctctacattcttaaatgccacagtcccctaccaacggcttaggtggaagcacagctcccacatcagcactgatgccctggcgcggccagcactgcctctacgaggccacacctgcctctgccaaggccactggccctcattcatctgcggggacgttctagagatatgcacttacagaccagttacttaaaaaaaaaaaaaaaaagcagagttcccttaatttagaaaaactcactatatatagcttgcattcagagccacatggaggcttaataaaaaataccaatttgttaggataaatgctttttctatcttggaaaaaaaaatcagacttatgcatcacctccagttaagcaccaacctaaaataaggtttgtattaattaaatcctgaaaaatcgattttttttcaagagggggagaatccaactcacagaagaaaaccaacttgaggatcccacaggcctcagacactgcaagctcctaaccagcggctcgccctcgcactgagtgggagagtgtctcgtttgtggttaacacagcgctctgcgacccctcccagacgtacggttttcactgaggagacttggggggagtgctctgctctcggctgagacgcttccccatggccgagggcgagggccggccccccgccggccgcctctggtctctgggggctccaggtgtggacttgagggctgggggctcccggtatctctctgcgggctctgccagcttcttttcctccttcccacaaccaacagtgtttggcttttgttctttttggggttgcaatggggaagaaggaggctctttactcgttctctgacaaatctctgcgtagctgggctttcgcaattcctggaaacagacaatcctgggttacctgtgtgaaatggtgtctctagggacaagacaggaaatcaagttcacttaagataaaagagttttcaactgtaactaagtttccatcttcactagtgtttttaacttttaaaaagttcataaaatctaatgatttagtttcccctgcagcagaacactccctctgtgctactgtagtaatggataaaattagaaaaggcatgacgaagaagagtgctgactcaacaccatccctacccagccctatgcctgcttgggcaatgcggaagcctaggaagagtccggatgctgcccacactggctccgccagctcaggacaacagaagggtgtcccaggtgcccacggtgggcaatggaccctcacacggtactcaaccctgaaaggcaaactccaaaaacagtctttaaataaaaatgttttgcacatttcaaactacaaaggactggaaatatctaagaatgatgaagacagctaaaatcttcaagaaatgtgtaatagggttttcaggtaagtggaagcataaagactaaataacagaaaagtaaaatatttcccttaataacttttttttttttttttttgagacacagtctcactctgtcgcacaggctggagtgcagcagtgcaatctcagctcactgcaacctctgccttccgggttcaagtgattctcctgcctcagcctcctgagtagctgggactacaggtgcccaccaccaaacccagctaattttttgtattttcagtagagacagggtttcaccatgttgttcaggactgtctggatctcctgaccgcatgatctgcctacctcggcctcccaaagtgctgggattacaggcgtgagccacagcacctggcctcttttattattattattatttattattaaaattattaattttaacctataaaaaatccttttttagactcagcccaggggacagtaagggattaaactcccaaattcaaggaaaaggctcccccaagatcaaactacagaggccacaactcagagtaagagaggccacagttcacccagtagggaaaacagcagaaaggaagtcgctggggttcaggcctgctgggcccacaggggttggaggctggtggggccaccatcttgctcttcctgtctcttcatcagacacacgatgcgcgcgcacgcacgcaaacatacacacacgcgcgaaatgctgaaatgatcctaaagtctatggagaaacaggagctggggtcttgttactactcaagaaacctctattgaccaacactgaaataaaaggactacatggtggtctgagaaagaactagagtagttagtggaaaattattagcaaatattaaaggtattttgtacagaaaacacaacacagacagacgcaaataaaaacccaccaaattagatgtgattaaaaaacgagcaggtgcaggagtgcgcagcgtctgttcacaccagagcctcgcggctgtcgtgcaggaaggcaggcacgaggtacgtaccgtggcggctccgttcacctgcaccgatttacacgcggtcgcagtgagggcggaaggaagtctgtccacactgtgggtttccctctgtttctccgccaccttgggatcactgtaaaaatgccacccgatatttgaatctcatgcaacatcacaggccattcaagtcagtcaacaccaaggcgctggaagaacaccaatactcactcgggtaaatgagctggggagggggatcgctcgtacgttgctgatacagcacaagaagccggcaccgagggctctctggagaccactacaggaagggtgttcacgcttgcgtctgcactgagggtctgaaacagggtcaagagtgttcatcagagtcctgccggcactaagcggagctggtaccagtgcccgttcaccccacccgtgaacagccttgggagagcagcacaaggacataggggaagagggtcttctccagcaaaaatgtcacagagcccaggactatcctctgccccacagatcgcccacccttctctttctcggcaaatgccccactgttcttacatcacaggcccttatctcctctcccgcaatgatgatctacaagcttatttcttaactgaacaggcatcaaacacatctcacccacctggcactttgggcccagcacggcacggcacaacaccacatgcatatctgctgagtgtcgaatcctaacacagtccaacacaactcattcacaccgctgagaaaaaacaatcggcgcctccacacccatataaatgtgagctcccagccctccctgaattcacaaccccaggaagcaggtgtgcgaatgcccccatctcaacaggtgaggaaactgaggcccaatacctctaagttaatttgcccaaggccaggaagcaaaggacggagtgaaacttactccctccttactccagccagcgacccctgtgcaggggctatttcatgtgtgcttgatcttatacatatggcatgtgatgatacacttgtcatgcaacttaaaaaaggcaggagggcaggtgctctttacacttctgcccttagatgaaggctgacgacagacctagagcccttccagctggagaaccagaatccgctgcaattcctgcgctcgaccagcaggaatccagcttggtggaaacaagagggcaaaggactccttttgtaaaagctcattttaaattcagggtaggggccgggcacggtggctcacgcctataatccccgcattttgggaggctgaggtggacgaatcacctgaggtcaggggtttgaggccagcctggccaacatggtgaaaccccatctctactaataatacaaaaattagccgggtgtggtggtgcatgcctgtagtcccagctactcggtaggccgaggcaggagaatcactggaacccaggaggcggaggttgcagggagccaaggtcgtgccactgcattccagcctgggtgacagagcaagactctatcttaaataaacaaattaactaattaattcaggatatgtgcagtcccaatgcaaatgaaatgcagatccacaactgcaggtcatgaagcaagtcagagtgaccatcacgagctccatgtcaacaggggaagggctgaaccccatcatttctggagcctccaccccactttgaaacccaagggccacgctgttgactcaagaagctcccaagaagcagcaatggagcccactacacctgggtggtggcataaggctcagggtcaggcttttcaaagaagcaattctttcttcaagagaaaccttacacaagactcaaactgggcacagcaggagctgctgtttctgaagcagggttggagacctgcctcttctcctccactcaataccaacgggagtaggctacagttggaaaactagaattcatgatctttaaactgcatttcttctcaaggcactaataccttagaaatgacggtgtggaaatttaaggctaatgtgacaatcctggaatgtactcaatctccaaacaggagcatgaccatctaccaatatgaaaaggactagacacgtcacctggctttcattgtaaagatactgcatcaaaatccaccttaaattctgccctaggaagtgaggaatggttctatctactgcggggccttccctaaagcccagggtggaagagacactgactctgcagacctgggtggggtagcaagcagcacggtcatgtggcgtggaacagacacgtggtaactctggggcacagctggggaaagggcccctggcacaggggacaccggcaacctggagtgctcagcaggttcttcctgggctcttcctatgcacagtaggtaactgggcagaaaacttcctctgtacttcccagagccttcaacgccaggtgtggcagccggccaagtcccacttccacctcctaagcacattagaggccagagtgctgggctgagtgtcctctgtcatctgcagctcgggacgactcctgggatgatattcactgcagtggaggcggcacctcgtggggcagcccagacctcaccagaagctaccgacactacagtgaggttctcccaggcttcttgctccttgtctcatgtagattactacacattttaatcatttccaatacaattcagatgtttccatttcattctgttgttttataaaataaaggcaggtctgaactacaacaatgacaatgcaatctaagtttctgggtgagagaaagggtgtgtacggcacatcatggcacacgtttctacctctgacttcatcagacagcaatgttaaggagaaggcccagccctgggttcaaggctggccttactccaaatctgtgtgacctctgcaatcacgtggcctccaagcctctcttgagtattaaaaacaaacatgtataaagagctcagcaaagcgcctgacacggaacccgtacctagacactgttggcaactattagacatgcaatatatcccttaccctttctttggatggtcctattatcaagctagatagcctgttttcaaacaagtcctctgtcttcaaattgccggcagctccaggtaatggagggaagctggacagccccagctcgaagcttggcgacggaggctttggtggcgttggagactgtgtctggctgctctgcaacagaatgacaccccagggtcacggtatggagagagaaggccaagcagcttctcgtttccacacctgtctggaaaatatctgtagaaacaagcagatcattcaacccagacaagggcttcctcactcaattgaaggttctcccaagcaacttcaaccatctagagcagagctgtaaaactgaaatctcaaggatgctgctgcccaagagatgtgtcacaaaggacacagtgaggctaaggtgacatccaaagagctatccacccatggctgccagcactcacgaacagcaggggcagctgaaggcaagggagacactctggagtgactccagcccaccagatggaaagcagggcagcctgagtctagacattaaactttctcactttcagacaagtgttgtgttactacagcatagtttttaatgtgagtcacaagataattgtaaaaaacaaaatatgacactctctccacaacctgtgtaagaaattttacacacgtgcatcaaaaaagtggtttaacaaaagggaagggggctcgaattctctgaaaataaacttaatgaaagtttatatttttaaataattaaaaacacaggatttgacaacaaattctaatcagattctttgacttccaagaaagcaaactcagtataataagaagtgagtgtactttgtaagcccaaatctcagaagaaaggcagtaataccttttattggaaaatgatctatcaacccgctttaacaagctggcagtcattttgcgagtacgcagttcctcggctgaaggacacatggcacagaaaggggaaatgagtttgcatttagtttagaaatgaatttatattaactaaagaatacaactatttttagctgaaacaatgagctactctgaccaggaagcaaagatctcatgggatccacctaactggaaagtgccaatgtttctccaaagtttatacacaggaaggtgaatccctgcatcagtagattctagagaaaatatgtcagaagtgaaagcaggtcaaaggatgaaaatgaattcaggctgacacaaaccccagtccagtctgtgttgggcattccgcttgcttctctgctccacgcgacaggtgcctaattttagcttagcttttcccagttaggtgtccttggcagtaagcttgttacctactgagcagctggctgttgtatgctctctgtaacctagtattgtgaatatgatgctcaaaatgatcctgcaaagctctaagttacacatggccactatgatggcaaagcggttttaaacatctgcacgtttctgaggtgaacacagcttttcagaagataagcattattagagagacagccttccccaaaaatgtatttaaatctcaacttgtagaagcaaaagaggcaggcaacaactgcccagatgtgggagttacaaaatgacatcacccacagatgggacttgacttggaaggcagtgttaaaatcctctaggatctgagcacctctgggtgaggtctgagtactgctcaggtcccatgggcgtggttaggcccgaggctcacacacttttacagaaaaagcgtctggacctttctgaggtcctgagagcacgtacataagacgatgggcgtatgctctgtaatcaatacaacactgggccacaagccgaagcttcaaagcaggtcacagtcatgaacacatgcatcaggaatgcaaggcaaaacagaacggaagagaaatggctgtgggaaaacatcacggcaggcacaacagtgccctgtgtttagatgcttgacttgttagtccaaatggtcacaggaattcactaattccaattgcaattaactggtaaaaactgccttaccaactagttaaacaaaaactagactaagccgacctcatgaaaggcacaatttctgagttctaaacagagattgtatcttttgtgatgagaaagcacctgtgtgatggcttgaggggctggaccaggatttgtccaggtctcctccagcattccttgtatggaattccacatctgcaagcccatggaggcatccctcccatcttcgtgggtactgctaactgccaccttgctgtcccactactggttcgtgggtactgctaactgccaccgtgccatccctcccatcttcgtgggtactgctaacactgccaccgtaccgtcccaccactggttcatgggtactgctaactgccaccgtgccatccctcccatctttgtgggtactgctaactgccaccgtgccatcccaccactggctgtggagaagtccatgccatcctccactaaagaccagcacaaacattttccacaggagaaactctgattaatcaacccaagcaaaaatcaccatgtctcatgtacttaccgccacaaaaacctatcacttatgtttgggtctgtcctgccagtaagttatagcagaaggagataatgctttctacacagtgggagagtattcgaaagttttgaaggaaaaacaccgacaaacaaattgctccgtggaagatgcttactctgctcattgaaatgaatggctccagtcatttcagactctccggtacagctgccacacagaagagctcacgtgcacacccgtgtgtaggctgcagtgcatgcgacagcaagttcctggccatgcctgtgccacagcacaacacgcctgtgcactgtggagtcctgtgcagcacatcgctatttccaaaacctctacagttgcttcctcctaggccagccagggtgtcagttattacttagtggatttcacgttacaagtcttttgaaatgctcattcttgtgccttaaccttaatccatttaattaaatctcaggtttggtataaattagatttaaatgtcttgtgaagaggtatatgctttatgtactcactgtaaacttctcctcccttttcttccggtagccaaaggaattcttcctagaggagtggaaagtgaaagactgttatttttttcccacttggagaatttattattgagcacgtttgcactcacataatcaaagtacacatcaattcagtctttatcactttgaaacctttcaaagatgactttcaattctaaaatcccaacttcaggaagcgtaagcagaacaacacaaagttgacagcaagggactaacgtggaagtccaggcaagtgataaagaacagaagaaaacactgactgaaaccaactccctggtgcctccttgggatgtctgttaagacatgagtactgaacatccactgggtggaaatgacaagacacataaaatctgagactgagctccatcaatgagttgtttaaaatggtggtgagaattttcccggcgcagatttgctttacatcagatttaaaagaccccaaataccgcgtcccatcccttcctctgccctctcagcttcctccactactgcctcaatggctgaccccttcccacgaaaaccacacaaggacctctgtgccccaaagacttcctgccctcgcctcccagcctcaggaaccacattctggacctccccatgcaggcagcaaggccacgccacacacgcagttgataaccacaggacagacactgattaagtggtgacttcacgtggagacctaggactctaggatggccaagacattcccatttccctggacaggttatgtggtctaacaagtcacatgacacacattcatctcaatggataatttaatggaatgcaaagactcccccaagggccttgtattacataacctggaaaggagttaagaaatagtcttgactaattccttcatttacagaaaaccaaaaactagtcttgcctaagatggcctaacagtggaaaactctgtggaaccttgggccaaaccctctagggcaaggacggcacaaacctttaggattctggagcaaatccctattatctcctacagaaaactttctggaaatagctcctggctttctactggtgccttgcggagactgcaggccagactatgggacatggatgagtactgagccacaggtggggcatgagtcctgacaacccaacctcctgtaggaacagggggcttggtgctccttgtcctggatccatgcctgtggcctcacagggagagagggtcctgggcctgcattatggacagccaccccagtacacacctggctcagcaccactccctaatagggggtgctcccaaaacccagggagctgaactcctactccgctgcgccaggattcagaagtagtggaaaggtggggctacaatgacccatgagcagagctagggatgcaaccagatgagagtcttcagtgggacaggactcaactggccctggggacctgggaggggtgtgagacggatggtgtcagcacctgcttgcccagaggcattgccctgagcgctggacagagggacagcagccacatgggcagaggacatcccgcagggctcggcacagggcatccctccgccaagggcagcctgctcgtcactaccggctgggacgcaggggcacccatcccttggaacacagcggtgtccaggacacagacctgcctgccatggggtcctatcccagtcaccatcagtgggcccagccaacactcccccacaccctcactgggctccacgtaacccgtgtcagacccagaagcccacctgcagccgtagaacactgtcagctgtcagtgcccatcatgcagagagcaggttggctgagccaaggctcagtgacagggccatggtgggttacagctcacaaggggtagcaagggacccagggtggtcccagcaccatagaggaaacatcactgtgacacccgcgactctgaatgcagtggtgtgaaggcctgagaccctgaagaggtgtgcttcccccagctgatcctaacagtagctccaccaaggcagccacctggcgcctggggctcctcatgccattcaacccagctgggccgtgccctgccatggccgccatgcaagggtagggacatgtgtctggactctggtaaggggttctccaggacatcttagcactttggtccaatagagaaagttaatggaaacaaaacaaaccctcccaaaaaggggaggtggaggcatggctgctgtggatcaggttctcagggcaagcaaggcctggcacacctccctgcaaaacagcacaagctctttctcaagacagagggaaggaggaggttacgaaggtcagctctggcttcagaacccatcgcagaaacaggctgcaggagttgcatgcgctttccctgcccaccacttcctaaaccactccctaaaccactggtgcgtgcttcctaaaccactccctgcccaccgtgcccatgctggtgtgcgcttcctaaaccactccctgccgcagtgctcaggtctcaggtgggaggacagttgtcctcccttggtggggagagagagggtctccattggtgcaagatctgcatctgtcaggcaaaagcataaacttgttacagttgcatttggaagttcaagtattgttgaagggtatcctgggtagaccacattcgtcagcaagctttggactctcagcttcaaagccacctgtatacattttgtgaggtagctggaattcaacaagccccactttcatttgccaggaaactccttgtgacgctcgtatgaacaaggcacactgaagagcacaggaggctgaggccggggggccttgtccatctagtctgcctccttccacaccgtgcccacaattgatgcccctcagagggagccacatggccttgatgagtagggctctgtcccaagtctgagccccagctctgcaaccctcctccctccaagcgtctgggtcttaagaaccccaaactgagacccagggctagcaactgctccctgaagtcactgactctccatgacacggtgggccccttttggctttgcatctccaaggcctgttgagccaacctgatgccatgtttcctgtgagacacaggccagtgccagctctcccagaccatggtgccttccaatgccactgcacaatccctgcaggaactcctatgtgctcattgaatcattatgggcaggaatgagatgcttctgatgcctcttcatgttgaattctcactgcacagagggtgtgcactgtggcaggcaggaagaggagcttgcacgtcagggatggtgctgtacacattgtatatagaacaccctgaaaaagctcaggtatttgagtcacttgtttgtcacttatgagaggaaaatcctgacggtccttaccaaggcaaggactgagaagatcaactggccttatcaacaatgggcaggtgcggtggctcatgcctgtaatcccaccactatggaaggctgaggcaggaggatggctctaggccaggagttcaagaccagcctgggcaacacagcgagatcctgtctctacaaaatatttaaaaactagccaggcatggtggtgtgcatttgaagtcctagcttctcagcatgctgaggcaataggattgcttgaacccagaagttcaaggctgtagtgagccatgatcatgccaacgtaccccagcctgggcaacggagtgagaccctgtcttaaaaacaaacaaacaaacaaacaaacaaacaaaaacctactacaggattgatgccaaaaaaatgttaaacaaaaccaaaaatggtgggcaggaagcacagctaagacccgtcctggctagtctcaaccctccaatgagatgagactgcaatgctgatctgcctggttacccgctccaggctccacctgcagtgcctggtgcacacccagctggagggcgccaggccagcagccatggggcagagcctggacaccgcccttgcagaggggcctggtgagccaggggtgctgccaagaggagactgcaggcacatgggatggagtctatggctattgagctccagtgtttctacaaataatgatctaaaacaactacagttctcactgaaccatttcatattccaaaaaagatgaagccatttaagtcttagcaattatataaaacccttatgtttatagccttcagttagattttctgtgacatatttaaagacaattacaaaacatatctaaattaaataatttttaaaatattagtttatgatgttacacagtaactgctcaacaactcaccttcccctccctaaaccaggagaggattcgagactgcctggctccacacgcccaggcccagcctctctcttggcatatgctgaagggttttgaatccgtgttctagtttgacctgcttgccttgtttgtggactccggacaccattaattaatcgatctgcagtgaagttaaatattgaaggactttctaataacccaggtcccctctctgcactaggaatcgcatgccgcagatgagatttactaggattcctgtaaataaaaatggttttatgtgttgagttataaaatgatcaaggcattacataacatgcatactgacatggaatagctaagctgaaatctgctctctgtttaataaagtataaaaataggatttggaatggttaactcctaacatataggataatgcaaatctattaacaatgtgccacaattctgcttagctgtttttcagtccaggcccaaattaaaatcaggcacacctgatgtgtacaagttgccccaaagcctcctctcagagaatctgaggcgggcacccatgccagattgtagtgcttagtctttacagaatgcagctgtgtgcttcaggtggctctgtctgcgaggagcaggactagtgatcaaagctctctcatcccaactccggaagggcagtagcgtaaagaccaaaactgctaagaccgccccggaacttgcctgcttcgaggaggatactgtctgagagaagtcagaggagacgccgcaggcttgaacgctggagacgtaaacccatttataaatccagtatttggaaatggagttacctagattcatttgaaaacagacaagtaaataaaccataaaacagacttcaatttcattaataccaacaaatctgtggaaactgagggcatttcttgatgttgtcagagtcatgacccatgctgagacatgtattttacaattttatcaccaatgggtgctgtttagaagtaggctggagcttttgtgcatcctttcagccaatccttacaacaatccagcgaggagaactgacacatgcggaagcaggcactgagaggaaagacgtggtcaagagcgcatgggctccaacaagtgttgtaacctttagcatgtcagtctgatacgacctccatcactggcaggaagtcaacagttcttgattcctgatggctttaatacaactcatcaacattctcaatcttaggagcacctgcacacccactgctgctcactcggcttcatccaaccacagcctgacagggcctttacctttaccccgacacaagtcctgctctgcagatcagggtattttcagatcatcattattccccaagtcacaaggtaagtatggcatgcaaatatactaacataagattcagaagaaattagaaagggtcacagaacccctaaaagatcttaagtagttaaaaatattgagcatagaattttaagtatcggccaactatttttaaaatctagacacatacaaaaataagataaaacttattgttaaaacagttcctttaaaaacaaacaaacaaacaaaactcaagaccattcattctaattctctggcttctggacccatggtttccaatacgttctgcatcactgatatctcgctccttatgctcctgacacagggcacttagttcctgagggccttccagtccacaccctcaatgtcactaaagtgacagagatacgcatagagccctccttgtttggaggaagagagaaaggaaaggaaaaaagcaagtaattctccttaattagagctaactggaagatataacagaaaaagaatattatagcttaggactaaaataaaatcatacaaaagggaagttagaatcttcaatttgctacttgagaaactcttcactctgtaagaatcggactttttaaaatacatcacacatggccgggcgcagtggctcatgcctataaccccagcactttgggaggccaagggggggcggatcaaaaggtcaggagatcaagaccatcctggctaacatggtgaaaccccgtctctactaaaaatacaaaaaaattatccgggcgtagtggcgggcgcctgtagtcccagctactcaagaggctgaggcaggagaatggcgtgaacccgggaggcggagcttgcagtgagccaagatccggccactgcactccagcctgggcgacagagagagactctgtctcaaagaaaaagaaaatacatcacacttgaagagccatgaatgcagacctggatctgaggctgtaaatcatgggcagagcaatgaggactaatcatttccagcaagtcattttacagacagagccctgatattccagtaattttgctcaagataaaaaataaaattggtcatatataaaaaataaagttgattattaatgcgttcctattattacttgttggggattaataggcacaatctcttcagctgcagaacaaaggacgcacatgttttagcacaagtaaaaggctgcgatggagagccccagtatcacagactcagagcaggaccagctgtctggcacacaccgcaacctgaacatacaacataagtcaaggccataagctgacccagaaccccaaggatccccgagagggtcaaccatgattaaagaaacggaagaagcaactgctgcaggaagaactgaaaggactagcatggcaagccacgtgcagcgatgattcttcaacacccagagcctacggactcaagtctctctgaggttctctcatgatatgcttttgggaaaacgaagtattcagctatgggtacacttttatagaatgtgctacttcaaaaagccagaaacttttcttaccatcaggacttactcaaaagagacagaagtaactttaccaaaggttcttacactgcggtggttccagactcagggggaattggggtcctctgaaaatctctccctgtccccacctgcccttcacacggccttaggagctattttctaaatggagtatggtttcatttctccgcttagaaacctcagacaccttcccacaagcactaggccaaagcccacatgcctcaggacagctaagcacctgcgcagttaggcctggaaactgccagctcgttccccaactccctgccacccggtgtacgcttcagctcagacacccatgaatctacgaccatcttctgttcatgaaacttctctttgattccttctgaaaaactcatacttaacctgaaaagctcaacctagatgacaacacaatccctgataagacctgtcagtgttctggcattctgtacacgtgtctccttggcatgtttgacttttccagcctgagttgtttcatggacccgtatctttactttccgtgtatacaggcacttgttttctcaagttctctctgctctgcacctaccctccttttctgcctgtcagcggtgacatccctgcacatcagggtgcctggctcccagccatccgaccctgaggaccactcagtctttcccttagtccacagcgaaaccctggacatgaactcttctcaaagttactaactcaatttctgctttctgaccataaccttctatgtatgctacccttcaatctctccaattccaactaacctgcattgctacctcatgcaaacctctaggccatgaacccatcttcacttctcaactagacttcagcttcaaggacatgctcatccgtgtattgctgactctcgtgcatccaatgccaccaaactcatgctaattcccacccagaatgcacttgatctttcaagcatctatagcagcacacaaagagacaatgtctagatccagtacagacttatgaattccaaccataggccttaacaaaggccaaaatccataaaaattaatcctgtcgaccaactctaatgctggtgagaagtgagtaaaataaggctggtaaaacagcaggccttctccttggccttgctgtcagaagcctattaaacacctcttcctcctcagttaatcccccttgcattgtactctgtgtaggggacgccaggtacactacagcacttatcgccctctgcgtcttgctaagagctgcatgacaagaggggagacgggctgtgcaaggattgtgctcacagcaatccaaagttctttatgcataagctctgttctcagctacatttaaaatcccccacataacttgaaggtctgttttagtatgtcagactgcacacatatctggcttcctattagatgaggattttaatccttcaaattatctagcatagtgtctacaacataaattcctagtaaagaaatgacgtaccaagggtgggtcaagatagctgtgcgttgctgaccacgtctggggagtgatcaggctgtacagggggaactgctgctgggggctgtacatgggagggaagtagaacgacgtcgcgtagcgctgctgggcatacaggctcacgtccaggggtctaaatccattctttggcaaaaatgtgtttatagctattgcctttgcttttatccgtgcctgtttgaaaatatgtaagtttctattagaatacttaagaacatcaatttgcaaataaacaaagtataaccaatggtcttgcttaccttaattggttttccttgaaaagttttgacttcttctcgaaggtatttgtaagcctaagggcaaaattaagtacaaaattccattcgattaaccttatgaataagaggcaccaatagttcactcaatagctcaaatagggaaatatataattaaattatggtgaacagaacctagaataatgattcttgacactccctgggtcacagatcccttaaaataacctcataagagctatggaacgtgtaccccaaattctcacaaacaagatttgtacacaattttgtaagtattaacagatgccatagaagtctcccaaagaccactggctaagaaccttgacctggtggaaaatgatgaatactgagttcctagtattcatcccaatttcagattaggagaatgcagttcaggaaataccagacaggaaggaaaaggattaggatcataacatccaaaagtcattcttgatatatctccttgttcttctccatgttaattctacattaaacccctataaaactgtgaaggccctgcacctgattcaatatcatccgaccacattcgccacacgggctggcagagctcacactccactccacaaaaatggttactctatcttccgttccccttttccccctccatccaattaaaacccatctttcaggtttctgtgttttcttttctgaaccccacatactgtttataccatttaacactttataatatgtgcgttagtttcctcacaaataagatgcttcccttaaaagcaggaaaactactaactcctcacgcctccttacagagcttacttctcaataccattaaaagcatcttccaaaatacaatgaagtctgctgggagatgaagattaggttcaaatttccccccaaacactttgcaaatagtaaaacttctctgcccagatagaagaacaaaactgattttcctaggttgcttagcttgttgtccttagaaagtaaaatcacatgctttttatattgctataaaaattgtccatacaaatacactcaaatatttaagtttctacaacttgatttcctctgcagattatattcaaacttaccatcacaagtaatctcaatgcccaagtttagtcccaacatgcactaatagtaaaaactggtaaactatgcaattcatagggtgatggtggaaagaacttacctgttgtgcatcagcttctgtttcaaatgtaataaaccaattatcattatatgcaaattcacagtttataaattttggtaaattatctcctttaaatagtgcttctacttcctacaggaaatagagatgttagaaattaattctcaacaatgtcagtttttgtcctcaccaaaaatttttttaacaaatgcattctcttaaggaactatccttaaacaaacgtaccatgatgcctagtaaatctctcttccaaaaaggatgagggttcagcagggcttccagaatcagaatcacaatgccatagagaaaagcagtcacacaacttacagcttcccctactctcaagataccattaagctagattaatgtgaaaactatcatatcatgttctgggctgataactgcacaactttttttttttttttttttttaaaggcaatttaagaaaaaaaatttgcttggacttttgcttctggccatgatggactagatttactctcccagatgactcaattaaaaaaccaaagacaaaatacatgaagaacagtttcaggccctgaaccccagcgtgaacacgagtgtgatccctgagagggacatgaacaggggagttggccttcagtgcctgggccgcagagccggcagggtaagcctgcagatggccttccccacatcttcagcctgggaaacaaccgcctgagggatgagagggaacaagcccagggaaggctcaccaagagaggaatggtttgttttcccaccggccacagtggaaaactctcctaaacacacaggatagcagggacagtgctcagaagggcactgcttccgcagtggggaaaatgagccctagagaaaaggctgctctgattccacctagaaagttggttccaggtaacttcactgcatttcaaaacaaagctcaagaatatttattagaatacaaaaatattcagtaaagtaaaatttaaaactccgagcatctcctcaaaaatcacaaagcatgcaaagaaatagaaaatatgacctataatgcaaaagattagacctagaaatgacagatacgatagacttaatacacataacacatttactgcatatatattccatatcccataaaaggtaaagactgagcatattaaatatatatggaagattgtttttattttttatttttttttatttatttatttttgagacggagtctcgctctttcgcccaggccagagttcagtggcgctatctcggctcactgcaagctctgcctcccgggttcacgccattctcctgcctcagcctcccaagtagctgggactacaggcacccgccaccgcgcccggctaattttttgtatttttagtagagatggggtttcactgtgttagccaggatggtctcgatctcctgacctcgtgatccgcccgcctcagcctcccaaagtgctgggattacaggcatgagccactgcgcccggccagattttttttaaaagaccaaaatcaaactttactggagatgaaaaatacaatgtctgaaattaaaactacactaaataagattaacagctgactagacactttctgaagaaaaggacaaaaggcagaggaaaacatttaacaaaataatggctcgataaatttcaggtacgagaagtttgaaaactacaccaaagcatattgcaatcaacttgcttaaaaccagtagtaaaatcttcacagcagccagagaaagacttattacatacagaaggatggtgataaaaaccacagaaaacgtataccagaagagagagtatctttaaaacacagaaagggaggaaaaaaccccctcaatccagaaatctatatgcagcaaaaatacctttcataaataaaggtgaaataagattttcccaaacatactaaagctgaaaaaaattcatcatcggcagacctgtacaagacatgctaaaggaatgtccaggcagaaggaaagtccagattgacataaaggaatgagaaggactgtaaatggcaaatactgaataaatataaaacatgtttttcttatttttaatctctttttaaaagtgacttgtttaaagcaaacgtaacaacgatgtattgtgaggcttatgactgtgtagaattagaatgtgtgacaacagcacaggctagaagtggagaatgggagagcatggctgtaaatgggagagcatggctgtaaggtaaagaggcatggtgctctgtgaattacacggactctagtaaagttagagggtcagctaaaaaccctaaagaaagggggtccaatattttggcttccctgggacacaatggaagtagaagaattgtcttgggccacacataaaatacactaacactaacgatagctgatgagctttaaaaaaaaaaaaaaaaaaaaaaaaaaaaaaaaaaacctcaaaatgtttgaagaaagtttacgcatttgtgttgagctgcatacaaagccgtcctgggcggcatgccgcccacgggctgaagaagcatgccctaaagcaccactaaaaaacagaaacacagagttatacctaatatgccaaaaaaggagataaaaatacacatttaatcccaaacaaaaggaggggaaagggaaagaaaataaagaagagacaaaacagaaaacaaacagcaagatgataaatttaaatttaatcacatcattacatcattaacctcttaaatgtagatgggctacactcccaattaaaagacagaaattgggcccggtgcggtggctcacgcctgtaatcccagcactttgggaggccgaggaggacggatcacgaggtcaaaagatcaagaccatcctggccaacattgtgaaactctgtctctactaaaagtacaaaattagcttggcatggtggcgcatgcctgtagtcctagctactcgggaggctgaggaaggagaaccacttgaacccgggaggcagaggttgcagtgagctgagatcacaccactgcactccagcctggcaacagagcaagatgccacctcaaaaaaaaaaaaaaaaaagacagaaattttcagattggataagaaaagcaagacccaattacacactgctcacaagaaatccactttaaatatgaaaacacaaatgggttggttaaaagaggatagaaaagacataccatactaatgtcaatcaaggaacgtgagagtggctatattcattccaaattccagaggaaaaacagcaacaaggaaaaacagggccattccataaaaaattactagccaggtacacctcaaaaagtacaaaaggaatttgacaaccaaatgaactacaaaaacggtttccagggattctaatgccctatgttgttgtcccatcactggtaaatgcttactggttaaaagataaaacacatcaacgcaaagtcatacttgactaacggtaaattaggattatgacttttaaagtcaaacaataatactttaaggccactagactatcagtctactagtggcaagaatggttgactcctctgcctctgggaaaatcctatttttaagaaaatcagaatcagtatttaaaatgtactaatcactgacaagtacctagtgacatttaaagaataattttctggaaactcctagcctacatttctaagacccagtagaagggctctataataattatacagagtccttgggaacttatgttcttacgtggattgttttaggctacttattttccttcctttttttccccaacttttaatttatcaaagagtttcctttaaaccttctctcttaagactttcattgctcaagttttacaaaagacataaggtcagcagttttgaataatataaatactccaaaatcaatgtctactgctaaatgcagaaaattctccttggttaaagttttacaaacatttcaagtcttaaaaattaggatctatgttttaaatattactttgagttaatacagatgtccaaattaatcataagaaatatgctggtcctcggccgggcgcggtggctcacacctgtaatcccagcactttgggaggccgtaatcccagctactcgggaggctgaggcaggagaagcactcgaacctgggaggtggaggttgcagtgagccgagatcgtgccactgcatgccagcctgggtgacagagcaagactccgtctcaaaaaaaaaaaaaaagcaagcaagaaatatgctggtccttcatattcagacccttaataaaaataggaggaaaaaactataatcctaagttgtttttctccacatactacaatatagaactagtaaagacaggctaagtggaacagaaggtaaaacttgctagaataagaccatacttctatgagagtaatagaatttcttacgctaggcagagagctttgttggaatcctgccctttctcacatgctagggttgttttccttaagaaactctcacacacactaacccactcggactgaaaagcctgaaccgcaacgtccatctcctctgcagagaaggtgtgtggaaagaggtagcatgaacgacgaggctgaaatcatgtgagagatgagaccaacaacaaacccaggcttcctgtgttctgcgagtccccaaagcaggcagattccgttttctgaggtaggataaactaagttgccagcaccttctacaaagactttacctcatgatctcaaggtgtgaccatcagtgtgtttactacacaaagcaactcagtttaggcatctggacaaacagtagattttatagcaacacataacagtaaatggcttttcattacttttaagctatcagatactgtggttccctaaaattactgcccaagtcgggtggattatgaggtcaggagttccagaccagcctggccaagatggtgaaaccccgtctctactaaacatagaaaaattagctgggcgcagcgacaggcgcctgtaatcccagctactcgggaggctgaggcaggagaattgcttgagcctgggagatggagtttgcagtgagccgaggttgcgccactgcactccagcctgggcaacagagcaagactccatctcaaaaaaaaaaaaaaaattactccccaagttaccagttctctaagagtggccgtgctggcttggaccaggctgcactggtggctcagggagttattcacgatgcccctttgtcatagaaatacttgttttgaaaagttttttttatcacaaaagtgctctttttcattatttatgggtttactaatcttatttttaaataaatatttaaatgtgttatttttaatttctaaatatagaaatgcataaaccttcactatcttattataaggagtcctgagatcaaaaggtttggttatcattccctcctactctgtaactcactgtgtgtaaatcctgggaaaacagtgttaatgtaagtactcagtctaaaaaacacacagcccaaaaaaacacaaaagtaaaataaaatcaaaaccaacaaagacctttgggaaaatgtccaagtaaccttcagaggagaaattacttacttccacgggggtagattcagatatttcacgcaatattactatgcagcgattttgatttggccttactttttctcccttttcatccacttggactaaaggtaaagctacaaagagaagaaaaatcaatggtgaaacaaaaatattaaaatatgatatgccagtggaatgtgttacattatattactatattactaaataagctaaagaaacctgcaaatgggcaaagtaaaccaatctcacgttagatttttcaaagctcaggaatatggacatttaaaatcctgcaggagccataatgtatgtaacactatgaaacaaaggttctaaacagctcaagcactaagagcagatgaaaatacagggttaacggctttctcctttccaccagtacctaaagtgagataatcttgtttcataacttgtttctgtgtgcccttccctggctccctgatgatcatccctcacctaacggtcgtgcactgtttacattaggatgctcatgtgactgcagtaataggcctaatttagatttcgccagtttttacataaattgggttttggcatcacatctaagaaattacgcaatgcgcagattcgagtcacagcaagtaatgatcacaattagggctcagaggtgcccactgtcacaaagacacaaatcaccagcatcaggatgaaagtggcaacatcattacaggttctatcaacaggaaaaagataacaacggaatattatgaaaaagttcacactaatacattacatgaaacagaaacattccttaaaagacataaaccaccaaagctcaccctacaagaaaggtaactggtgcatgactgtaacttagtttttatatcttaatctgacaaaagatcatcaaagactcatatgctgaaaactgcaaaacactgccaaaagaacattttaaagacctacataaagacatattctgtgcttgtgggttgtaaaacttaacactggtagaatgcgtgaattcttctcgagtgaatttatacaatcaatgcaatcccaataaaaacaccaacaggactttttgaaaaattgtaatgatgattctaaaattcatataaaaatgcaaaacatttacaagggccacagcaaagctggaggttctgaacctactttaagactcactataacgttacagtgattaagacactgtagtgttagcatccaatcagacaagtaatcaagggaataaaacacacgttccagagaccaacacccacgtgcacgggcagtcaatacgacaaggccccagacacgtggggtgctgcaacagatgcacacaggatccataccccacaccatgtacaaacatcagcacaaaatagatgacagactcgaatgttcaaatgtaaaacataaaactaataaaaggaaaactatcataaccttggaccaagcaaagatttcttaggtacaacaccaaaagcaagatctgtaacacgaaaaaaatttacaaattggactatataaaaaatgtctacttctgcttctcaaaagacactggtagaacaaaaaaaaaaacagctgtacacttagagagcatatttgtaaatcacgtgtaatacatatttaagtgtacacacatacatcattgacaatgtgaccgtggagcaaaggagcatcttttcaacaagtgctgctaaaccactcgacatccacatgcagaaaattaatctaggtgcagacctggcaccaccattcataaaaattaaccccaaatggatcatggacctaagtgtaaaatgcaaaaccttaagtcctagaaaacataggagaaaatctagaaggccttgggtctgacaataacttcttagataccacactaaaggcatgatccatgaaaaaatttcattaagatttaaaacttctgcttcgtgaaaggcaacgtcaacaggatgagaagccattgactgatggaaaatagttgcaaaagacacatctgataaaggactgttaacatcaaaatgcacaaaaaactttaaaaatcaacaataagaaaatgaacaagattaaaaaatgggcagaagacctggacagacacttcacaaaagatttacagagggcgaatctacatatggaaaaacgcttcacatcatatgtcatagggaatgcaaattaagacatcaatgagatgtcactgcatacctgtcagcacagcaaaaatcacaaacaatgacaccaccaaatgctgccgaggatgtggagcaagaggaactcccattcactgccgatgggaatgcaaagtggtacatccactttgggagacactttggtggcttcttacaaaacaaataatattcttagcatatgatctggcaattgtgctccttggtatttatccaaaggagctaaaaaattatgtccacacaaaatctgcatacagatgtttatagcaactttactcataactgccaaaacttggaagtaatcaagatgcacttcagtgggtagatggataagcaaactgtgggacatccagacaatgaactattattccacactaaaaagaaatgatctatcaagccacgaaaagacatggaggaaccttcaacatatattgctaagtgaaagaagccaatctgaagaggctacatcctataggatccaactctaggacattctgcaaaaggcaaaactacagaggcagtaaaaagatcagtggcttccagtgactgggggaggcagggatgcacgggtggaactcagaggacgtttaggtcagtaaaattaccctgtatgatactgtaatggtagataatgtccctatatggttgtctgaacccatagaatatacaataccaagtgaacccttatgtaaactgtggactccaggtgacaatgatgtgtcagtgttggtttcatcaattataacaaatgttcctctgctgcggaatgttcatatgggaagaggccatgcatgtgtacaggggatataatgggagatctctgtactttgcttacaattttgctgtgaatctaaaactgttataaaaaataaagtctacttctaaagaaaggactcaattgttaataaaactaataaagtatgtgtgggacatctaaatagacactactgcaaagaagaaaaaggaaggcaaataagctcatttaaaaaatgctcaacttcattaatcattagagaaacagatgttaaagcctcaacaagatatcactatatagttattagaaaacataaaattaacatgattgcatacgaagtgtcagaaggatatggggcaactggagctctcatccctgctggtggtggccaaccgtaaaatggtccaaccactttggaaaacaggcaggtggtttcacagttgctcacacacctaaccacacaatccagacattccacttgtggctatttacccaagagagagggaagcacatggtcacacggagacttttacacaagtgtccacagcaatttgtagtggtcaaaacccggcaataacctaaatgtctataactgctaggtgcataaaccaactgggaatacccatttgagagaatacttcccagcaaaaagaagcaatcacctactaatccagtaaacaacaatagttatgccagaccaaaagaaagtgatattgcataatcgactccatttacatcaaatttgtaaacactgcaagctaatccgtagtgacaggaagcaaatcagtggttgcctggggagggggtagaggacgcttggcgggggtgggctgtgatggctgtttggtatcgtgattgtggtagtttcatgggtgtataaatatgttaaaacttacgaaatgtacacttagaatgcataatttatggtatgtaaattctacctccatacaggcaggggtgacaccctctgcacttcatgcctcgcccaactcacctgcccccatgacgtgacactgaatgatgagcttcaatcccgttcatgctttcacaccatctccgtgctcctctgaacccacaaaaattcctgtgcttcagctttacacacccccaagctttatatacatggtatcaccttgcacaaatttggaaatacgcttttataaacattataattttaaaatttattcttgttggaatatgtaggcctagctcactgtaacagctctggtactcactgtgtgtatataacacaacgtatttattctggtgacaaatattttagcatgtctttttaattagcagttcagttacatgaagggtgaaaacagcccttgactcagacatactgggacacgcacattgtgtttactgtgacattaaaaataatctggaaatgtaacttatgcaacttaacacaagagctgcactattcaaaggaaaatcattcagacaatcttgagtttaatttgtaaaaagataaaattaaatattcatcaaatatctgctgtgtgtctgagtctctgctaggtaatttgggcacaagatctaaacataagatgaggccaggcatggtggctcacacctgtaatctcaggactttgggagactgaagtgggcagatcacttcaggtcagaagtttgagaccagccctgccaatgtggtaaaacctcgtctctactaaaagtacaaaaaattagctgggcgtggtggtgcacgcttgtaatgcccagctacttgggaggctgaggtaggagaattgcttcaacacaggaggcagagttgcgatgagctgagatgacaccactgcactccagccttggcgacagagtgagattccatctcaaaaataaataaattcattcgtccattcaacttaatttaaaaaaaaagtaagatgagaactttgctcctgcggacctatttatgacattttcatcctcttaagagctacaatgaatgcaataacttgctaactatattcttgtcacataggttcttacaaaggcatgtacatttctgtccaaaaatcgagtgaaaaaagacaaaatgagaaactaaagagctcagtgcaaatggataaaagttaagtcataaaaaaggcgggaggagatgggacgaaataggtgacaagcctgccctggatcgcctatgggcaggtgggctctgttaagcaagcacacagagcaatttaatatcctcatggttggtggaaacgaccccttgccagtaacaatcaactgagaaatcatcccagtggggcagcagcgtttgcaaggtctgtccgaaaaggaataactaaacctgaaactcctaatcataaccaaaaagacttcagagtacaaacagggacaagaatgctgctggcctttcaaagatggggcccaattcagctggcacagacaacagcttctgttctgcatgatgacaccagggagcacggcgccatcctgggagacagcagtgccgctctcagaactcacagtcaatggtaattatgtttgtcagttttttcactgtctccaataatttaataacccatgctatttgtctaaaaacagaaaaacataaaacttttattttatattttatttgtgaaaagaaaatccaactaagttctcatgtaagatgctcacttttttatactactgtaaagtcaaattcatacaagaaaaaaaaaaaacctgcacagactgtcgtcagtacagataagccagggacaacgtgaaaacccttctatgtgagtataggcagtggacttaattgagacttgaagtcaggcttagcaatgtccaatcactcaaaactatgtaggggcaccatccacacttaatgcttaaacactgtttgatgttgccaaacttcaaagaaacaacttcactcacaacataatttttttttttttttatgagatggagtctatctctgtcgccaggctggagtgcaatggcacaatctcagctaactgcaacctccgcctcctgggttcaagtgatttccctgcctcagcctctcaagtacctgggattacaagcacacaccaccacgcccagctaattttttgtattttagtggagacagggtttcaccatgttggccaagacagtctcaatctcctgacctcatgatccgcccaactcgacctccaaaagtgctgggattacacgcgtaagccaccacacctggcccacaacataattttaagaaaaattgcaataattatttcatccgaacataaacaggaagttgcaatttgaaagaaaaacctctagtggtaaaactgtaactaaagtgtattttactttaactataaatgttatttttattttgtttttcatgaatgaaacagctatctttaaaatccccattaacaagattcttttctacttcatatgtcccaaaacttgtttgaggtttcataacgggttcaactggcattcccagggactatcaggcgctactccagaattattggacctgggcagaaaggaacggaaggccagaaaagaatctgattcgccatcaaggaccttaacgtttgatggctatagatttaaaggttcatgctgataagacaaatactctaaggacaagtattattaatttaaattgtcatttacttacatcttagcacttccacaatcaagtccacatcagtgctgagcttcttgatgtggtcgaggttagccaccgttgtgattggcacatactggtcactatccatctgtgatataagatacatgtcactagcaaggttctccctgttgaaagaaaacaatctcttttaatcagtatttctttaaaaggaagtttcacctactgtaattccagtttcacaagaggcgtgagtgtggcatggtattgctttggagttaaatctcagcccaggacccatctgttatttgctgtctctccagcctcaggtacatttttgcaaaatctcggccttggagaggcagggagtgcaaaagtaaaagtatactgtactttctacaatcaaaatttatgagaagatggttatttttaaataagatgtaattatttatagctgtcatttttgtcctaagaagtagcttaagagtttattaaaaatgcatacaattttgttaggccgggcacggtggctcacgcctggaatcccagcactttggggggccaaggtaggcagatcatctgggttcaggagtttaagaccagcctgaccaacatggtgaaaccccatctctactaaaaatacaaaaattagccaggcatggtggcgggcacctgtaatcccagctactcgggaggctcaggcaggagaatcgcttgaacccgagaggtggaggttacagtgagccaagatcacaccactgcactctagcctgggcgacaagagtgaaactctgactcaaaaaaaaagaaagaaaaacaatttaaagtaaagaaatccagctcaatgaacaagaaaggaaaacataaaaaggccaggataaggtcatacccaaaattcctcctgtagactctggaacactcaccagagggcctatatccagccctggcttcctagcagccagaattaaaaagaaggaaacagtaactttacccacaaaatccaaaggtgagccacaaatcatcagcagtttgggccatgatgagctattttctggtgttttggccaaagatcaatgtttcctgtgaattctcaaggcatcatgtaatgtagtgaacaaggccctaagaaacatttcaaaactgagcacagtgctgggttcctggggcctctgctcagtgtccctcggtgaaggcccatgactgccgatcaaacggaggccatgcaggaggaggccctgctccaccctcatctcggccatcttccaggtgtagctgattctggccccatggggctacacatggatgtgagtggcagagagctcacacttgtgctccactagggcgttccactggtgcccctgcaccttttgcgtctaccatgtcatggtgcggtattctcagactccaatcgtggaacagcatgggcatggggaggaggccagcagagcccctcacacctccacctcatacaccccacaggcttcaaggagcccctagcagacacctgtgtggaatcctcagggctccagagaaaacacctggaaaatcatcatcgacagaaaaccttatacacggcccatcggttgttgtcatactcagagaaattacatcaaacccaatcccatcctcctttatgtccagttctgccattggaactttaaaggttttactaagaaaagggtattattcaggggaaagaaaaatgattaaaaatgagtgttatataaataaaacaacttgctatctcagtgtctggtgtgctttcagaaacaacgtggcacacttgttctccaacttcagtgtgaggaagtctgactcggcagcacagggcgggcggggcactttagacgcattccagacagtgaccaccgagaccactggggaccacagacatgaaggttacgttccatgctcaaatgtcaaaagactgtcattactcaatattccacgtcttcatatacatatatatggatatgagtagatactccttcataaaatatcacatttgtatatactttaactatttgcacaatactagaaatatcaggtactagaaaaaccaccaccagccttacctagataagcagaattccaatgtttttttaagtacttctcgggggtcttcctggctgtctggttgagactcatttcctcctacataaaagtaataatcaacttaggaaaaccggcttaaaatttaggaagcagataattcagtacagcagttctaatgctttcaacttacgttctgacacaactacgtaagtgtatcctaagtaagaaaaatgctactttacctatcaaaaaagtaaatcatgcaaaaaaacctatccctttatcccccaaaacaaaaacagcacagtttagaaaaataatctaagtctcattagcagagttcagcaggggctttttctaccagaaatgacaagtgtaagcttagttaatgccttgtctcactgcaaaaagaattttcaagtaacctacacaaacacaaaccctaaacaataataaaatacagaggaaaaaattaaaacaacaacaacaaagataaccagcaaaaaaccaaggctggagatcaaacaggctctaggactagacagtttctacaacagaggcttcaatttgccttccaacttccagagtcgaaggaacaagtgagaattgtcatgttacagaattcctgtaagagaatgataaataaaccagatcttcaagaggaaacaaaagctggttctaaatcctggaagaaatttctaagaagatgccagagggcatggtgtgtgtggtcacaggcagcacagggctgtgaatttggagctctagaagacactgcataaactgctggactccggacactgcataaagaggtattttaataatgttgcgatgacaggcactgaaatgctaagaactaagtttttcctgccttcctatataaattagcatggtacaatcatataagagccatgctaacacaagagacacttgtatcttaaaagtcaaagttaaagaccatgaaaaggcaaagacaaagtggggcgttcaggacaaatgagagggatagagagtttgtatggtgttatacaatgagcttagtaaaaatccacccccatcagcaaaaagaaaccaaaactgctaaagtaaccataacacaaaaccaaatcatgggactcaatgagactgaaaatggaaaattgaaaacacaacctgatgccactgtccatctagactaaggtgtctccgggtcactcatctaaattcacactccactccccatgtttaataggtatttactaaatatttccaagtgccaggcactactgcaggctctgtgaattcagcctgaataacgcaaagcctgtgctctcgtgaagccaacactctggtgggagaggcagataacagacagttaaccagtaactatacacatcatgtcagagagaaacggacactgaggaaacaacccaggatgaggggcagcaaggcctggtgccatccagacaggaagtgccatatgatctgatagaggaggggtggggcacacaggaaggtgggaagtgtgttctaaatggggagcctcaagcacaggggtcccaaggtggggcctctcaaggggtagagtccagcagtaggaggccagcacagctgagaagaggggtgacagacacagtaagaaatgaggtcacagaggccggtgtgtgtgagtgagatcaaggaggacgttaaagtaacctaaacgtaatagaaaatcaattcaaggctgacattttgaaaatatctctctggttccatggtgtagacagactgtgcaggcaccagccggaagataatgcaatcactgaggacagggcactagggaggactctccaagcgataggtggtgccgaagccacaagggaaggaagaaaagcagcccaggactgaacccgggacactcccaccttcagcaggaggcaagcgcatgagggccaagggacacaggctcacagccagcaaggtgggaagaccactaggatactgtgaagttaggagccaagagaatcatccactataacatgacacagtagagccaggtaagttaagaagttgaaactaactactagatctggctgcaccagggtcattaaagagctcgacaaatgctgcttaggacaactgtctacctggactggactcaagagggaatggaagcaaggagacctggactgcactcaagagggaatggaagcaaggagatgggacagcaagcagacagctgaagtgttctacagtggaagatgggctgcccggggtggcttcacctaagatgagagataataccaccttagaaagatggggagtgacccaaccatgcaagaaacacccggcactgcagacagaggacactgaggagcaaagacaatgacaagtgagacgggctctcagggagactggaggttgggcacatggtgttggtaagacacaggccatctgcctccaggtagatggagtcacaggggctaggttaactttccctttaaaaccaccaagaaaccaaataagacagatgaaatgacagttttccagatgtgggacatagagcaacaaaggacatagattcctatgtgacatgaaacttttttcttttttttttttgagacggagccttgctctgtcacccagactggagtgcagtagcgcgatcttgcaaccttggctcactgcaacctccacctcccgggttcaagtgattctcctacctcagcctcctgagtagcggggattacaggcgcacaccaccaggcccagctaattttttttggtatttttagtagagacagggtttcaccatgttggtcaggctggtctcgaactcctgccctcgtgatctgcccacctcagcctcccaaagtgctgggattccaggcgtgagccaccgtgcccagcttgacatgagacattaaagtaacccccacaagtccagcccactgccctgagggaagtcccaggctgtgcccagggagtgggaagtcaggtgggaacccagtgtatggctgtgtggaagagaaaaagagaatgcaggagatagggaggctgattgcataggccagacagcaggaggagctccagagaaccacagggcccaggacccatcacgttgtcagccaggttctttgcaaagcacggatgtgatgaaactacccaaggctcgtggaagaaccacctgaggggatcagaagtataacaatatatgtcattcacgtgcagagcctgaaatggttaaccctccccaccagaaactcttgtgattcccggagccctgcctcggtgataggaacaggccccacacagcaccgtcccactcacacctaacatcttaaaaacaagatatgaaaggatcacactgtttccaagaaacctggctgcatcccagaacaaatatcaaatatttaaagaaatacaaaaatactaagccctgaatacagtaaaactcaatctaaccaaaaattaccatgcatgcaaagaaagaagcaggaagatatgacccatgacaatgagaagtatcaaccaacagaagccaatccagaactgacacagatgttaaaattaactgaaaaggatgttaaaagttatcataactgtattccatatgttcacgaagtcaggtaaggacataaaagttattaaaaaaaaaaaagaaaaaacttatagagatgaaaactccaatgtctgatattaaaaatacttgatgagattaacaacagggtaaacattacagcagactcgggaacctgaagacacagtaacagaagcttcccaaaatcaaacagaaaaatgagaagcacaaccagctgagaggatcagcaagctgcggacaacatcgagcagctgagctcaagtgtaacagcagaccctggtatagtcagccctcaacacagagaaaatctacacacaggagtagagagcaccagaaaccgccatgacatggacaaacacgtatgctgttttgcttgttacagtttcaatctcttttaaaaataactgacttttaaataaaaataaaaacatatattgtcagtttatagcataagtaactgcaaaaggcatgatgaccaaagcatccgggccacgagagaaacggcggcagactgccctgatgctgtgctctatgtgaagcagcacgcagccacctcaaggtagactgtgttagccggaggaagtggagcaaaacgcaaagaaatcattaaaacagcgaaacaaagaagaaggctgctccaaaggaaaacagaaaaaaagggaaagaggaacgaagaacacatgggacaaaaagaaacagaacacgtctagcactcaatcttggtttctgatatcactgtccaatgaaggacccagcgctccttggagaaatggctgattctaaggctgaagcaaggagaaacaaaacaaaacaaaataaccacaaaaaaaccctatgttgatggggcatgtcaaagggagccgaccagaactcctgatggccaaagctagaagaacaatttgagcaacaaaataaagcagtactggattataaccaaaagtataaaacaaacattctggaatccacactgctataaagagttgaataagtaaataaataaaggagaagagacaaatctcccatacataagaattttaaataatttacgaagattcgtgtcctcatggagggggaccataaatccccaactccttaagtgtgggctgtacgcagcgacttccttccaaacagtacaacatggaaatggggagggaaagggtaacttcatagtgagaaacccagtaaacagccaggtgatcaagatcaacaccaacagtggtaagtcacgttgacaatgtgcacccttgatatatgtgataaaagtggtgttttaccttctcaaacccattaccactatagtatcataatgaggaaaacatcaaattctaatagaagagaatgttgttacaaaatacttgactagtactcttcagaactattatatcaaaactaccacaaacaaggaaagcctgggaaactgttacagccaagaggagcctaaggagacgtaacaatgaaatataatgtggttctcagctgagatcccgcaacagaaaaaggacgttaggttacgatgtatcactactggttcagtgattgggacaaatgtaccatattaatgcaagatgtcggtaataggaaaaactgggtgccaggtatatgggaattctgtgtgttcaatcatctcaatttttctaagtctaaaactattctaaaacaaatagcaagatgagagacctaaacctaaccaaagcaattaccacactaaatgttaacgttctaaatagaagacaaaaaagcaaaacccaaatgttatgttatctacaacaaatgcactttattaaatacacaaatagcttaaagtaaaaaggatataagatataccatattaaggctagtcaaaagaaacctggagtgattacattaatgtgagacaaagtaaattgagagcaaagactattactaaagataaagagaggggtcaatgaatcaagaggccacaaaaaagtcttcaaaatacgtgaagcaaaaactgataaaactaaaaggataaacagacaaatgcaaaaattaacagaacctttctttcaatagttgacagaacaagtagacagaaatcagaaagagtacattaatcttgaacactaccactcaacttgacctcattaacactgacaaaatattccccatagcaacagcaaaacacatattcttctcaaggacaaatggaatatttaacaagacagcccatatttgaagccataaaataagacttaatatatttaaagaaattcaagtcatacaaagtatgttctttgaccacaatgaaattaaactagaaattaataaaagaaagatccctggaaaacccccaaatatttgtaaactaaatcaaatatctctaaattatctatgagtcaaagaaaaaaaatcaaaaaagaaatacagtatttggaagtaactgaaaatgaaaacaatgcatctaaatttgagagattctgcttaagcactacttatggggaaaatagtaaaactaaatgactatatcagaaaataagaaaggcctcatattaatgagctctgcttccaccttaggacacagaagaaagggtaaattaaacccaaagaaatcgtaagagagtatattacaaacatcagaagaaagaatgaaataggaaagagtaaaacaaatgagaaaaatcgataaaatgaaaacactaactttttttttttttttttttttgagatggagtttcgctctgtcccccatgctggagtgcaatggtgcgatcctggctcactgcaacctacgtttcctgggttcaagcagttctcctgcctcagcctcccgaggagctgggaccacaggcgcccgccaccacaggcggctaatttttgtatttttagtagagatggcgtttcactatgttgaccaggctggtcttgaactcttgacctcacgtgatctgcccgcctcggcctctcaaagtgctgggattacaggtgtgaaccaccatgcccaacagaaaacaccttttgataaggtcaataaaactaacaaacctctacccagactgattgggattataaagaagacacaaattaccaataacagagatgagtgatgtaacatgactacagatttcacaggtgataacagagtattatgaacaactctgtgctgtaaatcccacaactcagatgaaatagaccaaatctttgtaactatataaaccaaagctccctcaagaagaaataaatgagtagcactatgaaaaaataaactgtagttgaaagctttcccacaaataaaactcctgcccaggtgggacgcagtggctcatgcttgtaatctcagcatctagagaggctgaggtgagcggatcgcttgagctcaggagtttggagaccagcctgggtaacatggtgaaactccatctctacagaaaatacaaaaataagccaggcgtggtggtgtgctactgtagtcccagctacttgggaggctaaggcgggagaatcgcctgagaccgggaggttgggactgagtgagccatgatgatgctactgcactcaagcctgggtggcagagcaagactctgtgagcaactaaactaagtaagtttagtaagtaagaaaggaaagaagaaaaaaggaaaactcctgcccacatgacttgtttcacttcctcatatgagggtgaaataatacgtaacctcttccaaaaacttaaatagaaagaaaaacactgaaatgaaaactagaaaccaagatcccaggtgtaaaaattctaagcaaagttttggtaaatggaatccagtagtatatccaaagtatactgtatcatgatctacagaggtttagaccacaaatgttggtatcacatttgaaaaacaattaatacaattcatccgaacacactaaaaaacaacaaatatatgcccatctccatagatgacaaattacaatattcattcctcataaaaatctctcagcaaaccaggaaaagaagagtgcctcatcaacatataaagggcacagacctaaaaccaccactaacgttatacttcatggtgaaatactgagtgcctcttgtaagaccagagacaacccaaacgtttgttcattctttccacttctgttcacctttgtactggagggcctatctagtacaacggggcaggataaagaaataaaaggcatcaagattggagagaaagtaaaacagtcttcattctaaaataatccaatcatctatgtagaaaatccaatgtaatctacaaaaaagtgtctaaaactaataagtgagcataacaaaatttctgggtttggactcaatacataaaaatgaatgctttgatatactagtaacaaacaactgcaaatacaaattttaaaaatcacttacaatagcaccaaaaaatataaaatacttataaactggataaaagatgtaaaagaccagtacactgaaaaccaaaaaatacttctgagagaaattaaagatctaaacaagtaagagatacatcttgttcatggatattgttcagatgtcaatgttctccaactgatctatagattcagtgaaccccccaacaaaaatctcagcactttgtagatattaacaacctcattctaatttgcatggaaatacacaggaactggaatttaaaaagtaactatgaaaaacagagttggaaggctatcactacctaatttcaagaattattaacagtacaggcatacctcagagatatcatgggttcagttccagagtgctgcaatcaagcaaatattgcaataaagcaagtcacacaaagttctgttttcccagtgaatataaaaattatgagtacactaaactgttgtatatttaatgtgagatagcagtatgtccttaaaaaaaaaactacaataccttcatttaaacatactctattgctggctgggcatgctggctcaggcctgcaatcccagcactttgggaggccgaggcaagtggaacacctggggtcaggagttcaagaccagcctggctaacatggcaaaaccctgtctctaataaaaatacaaaaattagctgggcatggtggcacatgcctgtagtcccagctacttgggaggctgaggcacaagaatcacttgaaccctggaggcagaggctgcaatgagctgtgatcatgccactgcactccagcctaagtgacggagtgagattatgtctggaaaaaaataaataaaaagaatctattgttggaaaatgttaacgatcatctgagccttcagcaaataataatcttttttgctggtcctgccttgatgatgagggctgactgttcaggatggtggctgctgaaaacttgggtggctgcggcaatttcttaagacaacagcgaagtatatcacgtggacggactcttgctttcaccaaagatttctctgcagcgtgtgatgctgtttgatatcattttgtcaacagtgggacttctttcaaaattagtcaatcctctcaaaccctgctgctgctttatcagctaggtttatggaatattctaaatcctttgttgtcatttcaacaatattcacagcgtcttcaccaggaatacattctaactcaagaaaccattttctttgctcatccataagaagcaagttttacacattcaagttgtacatgagattgcagcaattcagtcatattttcaggctgtacttctgattccagttctcttcctatttctactacctctgcagtgactttctccactggtcatgaacccctcaatgtcctccgtgagggctggaatcaacgcctctggttaatgttgacattttggccttccctcacgaatcacaaatgttcttaacagcatctagaatggtgaatcctttccagaatccatcagaggaaccatgatctatacagctagagccttatgaaatgtattttttaaataagaaaatttgaaaacacaatgactccttgatccataggctaccgaatggatgttgtgttagcagccatgaaatcaacattcatctccttgtacacctgtcagagctcttgggtaactaggtacattttcaatgagaaattaaaatctgaaaaatatctttgtttttttttttcctgagcagtaggtctaaacagtaagcttaaaatattcagtaaaccatgatgtaaacagatgtcctgtcatccaggctttgttgttccacttaaagaacacagggagagcaaatttagcatcattcttatgggccctaggattttcagaatgggaaatgagcactggcttcaagttaacgtcaccagctccattagccccaacaagagagttggtttctaatgttgaaaccaggattaacttcttctctttagctatgaaagtcctagataacatttccttctaatataaggctattttgtctcgattgaaaatctgtcatttactgtagccatcttcatcaattatcttacccagatcttctggataacttgctgtttcaccttgcatttttatgttatggagactgcttcttttctttaacttcatgaaataacctctgtgagcttcaaacttttcttctgcagcttcctcacctctcagccttcacagaacttaagagagttaaggtcttgctctggattagactttggcttaagggaataattgttgtgactggtttttctatccagatcaaagtttctccatctcagcaagaaggctgttttgctttcttatcatttctgggttcactggaggggcacttaatttccttcaataacttttcctttgcatttacagcttggttaactgtttggctccagagaccgagttttcagcctatctcagcctttgacattccttgcttactaagcttaatcacttctagtttttgattaaaagtgagataagtaaaactcttcctttcactggaaccctcagaagagggaatgtagggctattaattggcctaatttcaatactgtcatgtctcagggaataggaaggcccaagcaaagagagagagagacaagggaagagccagttagtggagcagtcagaacacacacgtcatttatatattaagtttgccaccttaaatggtgtggctcctggcaccccaaaacaatggcagtagtacaaaacaccaaagatcatcgatcaccactagcattaataataatgaaaaggcttaaaatattgtgagaattatgaaaatgtgacacagagacatgaaatgaatacatgctattggaaaaatggtgccaattacttgcttgatgcagggttgccacaaaacttcaatttataaagaaggtggtagctgcaaagcacaatgaagagtagcacaatgaagcaagctctgctgacaatccaagcagtgcactactggagtcaaagcgggctagcgcatcaatgaacagaacagacagtccaaaaataaatccagacctacgtggacaaacgacttctgagaaaggtgcaaaggcaacgcagcagagagaagtctttcaacaaacagtgctgcaatagctgcagattcctatgcacaaaatgaaaataactttgatccatatttcataccttatacaaaaactaacctaaaatggacctagaaatgtaaaatctaaagcaattaaacttataggaggaatataaaccaaaaggaagagccataaaagaaaaaaatgataaacttgattacacaagaaattttaaactgcttttcaaaaatactcttgggagaacaaagtacattgcgtatctggacttatatccaaaacatataaataactatcaaaagtgagtaataaaacaacccaataagaaaatgcacaaacaggcacaacaccaaataagatatatgcattacaaaaaaatgctgcaacttcaggttctgcatgtgagaagcctgcaagttatcactctggtctgacaagtaaaaaatctaaaaagaacaattaacaactcttcttagatcctacgtaaagtcacaaggcaaacaactgctgccaaattggacagacagacagataaatagagaagcgatcacaacatatggagcagaaacctttgcaggaaccaaggcgaggacagaaaacactgtcctggaactgattaactgctggaggctcagggtggccaagtctgagagttaaaaactgcagggagtctcagtcattggcgggtgaggggttcctgcacttttgtgacttatactttctggagctcgatcaggtcctcacagggaatactagagaaaaatccctttgtgcttccggcacgagtaggagaaaagtaaccgttttgaaaaataccagagcactctgttcttcttaacaaggtctgccctcaggaaagacagtttaaccacagtccaacttgctggggtttaatcagagcagaacatacctagaggaagggaaacacctagctcctgcctcctctggtcatgctgccccacctaagaggggaggaaagaagagaagctcctgtgagcttcacagtccagggcccgggctcactacagacttgagactcccaggcctcttatggaaggcgtcccctgcccacacctcaccccacagcactgaaggcatagtcaccacagtgccttccacccagcacgtcacagctggctctcaagaaagttacaaggcatacacaaaggccaaaaacacaatgtcaagagcagagcaagcattagaaccaggcatgacagagatgtcagaattatgagacagggaatttaaaagaactaggataagatgctaagggctcaaatggataaaggagacagcaggtaagaacaggtgggcaatgcaagcagagagatggaaatcccaaggagggggaaaaaaactgtgagagatgaaaactactgtaacagaaatgcagactgcctttgatgggctattaggagactggacatggatgaggatctatcaacagaaacctctgctggcactcagaaaacaataccccaaaatgaaggcctcagaaacaaaagttttttgggtcttgttttatgtccttgagagcttgaactgtgaccaagtgggagcactctttggtctccaccattgggggaggtacgattttcggatcaggtcgggtggccggtctgaagacaggaacccaagactttttgttctgcatacgtcaagcgctcgggagtttgtcttaataagaggtcccacgtgtaaggggcttttgtcatctcaactcctgctgcctggttagtctgtgtcaacaagagtctttgctgattgagctcattcctgacagtaaatgttttgtgggaggtatctttggaattgcttcttctatgtcctctccaggatctatcctggactttatacaccactgaaaattctaaatgtcaatggccaaaagatggatcctttaaattagaattgtaaatttaaaaaaggattttagaaatctcatcctaaacaactgataaaaacatcaagagcaaaaagggtgcttggcatcactaaccactaggaaatgcaagccaatttctagaaagacccaacaatgctatggttagccttaaaaattctctttaaaattaaagagcaaaaatctgacctgaaacaaaattaaaaattttttaagcttaaactcctactttggatccccctgttggttaacaatgagggctcctctatattcttgtaggcccacagttaaaattccaggctttccctgcggtggcctattagacacacagcccaatgcaacagaagagagggccgagaaagaaatccttgcatacatggccaattgttttttttaacaggcgtgccacgatcgttctatagagaaagggcagtcttttcaataaatagtgcaaggacaactggatatccacatgcaaaaacaaagttggatccatactttataccatatacaaaaattaactcaaaatgatcaaagatctaaatgtaagacccgaaatgataaaactcagacgaaaacacagacaaaaccttcattataataaattcaacaatgttatcttagatatgacaccaaaggcataggcagcccaacaaaaaataaacaaactgaacattatgaacattttaaattttgtacatcaaaagacactttgaataaaataaaaaggcaacccatataatggaagaaaataattgtgattgatgtatctgatcagggattaatacacagaatatattgagaactcctaaagacattaacaaaaacctgattcaaaaataggcaaaggatttgaatagacatttatccaaagaagacaaatggccaataagaacaaaaagggtgcttggcatcactaaccattagggaaatgcaagccaaaactacaaagatatacccactagaatgactactatcaaaaaaatcagaaaataggctgggcgcagtggctcatgcctgtaatcacagcactttggcaggccgaggcagacagatcacctgaggtcaggagttcgaacccagcctggacaacatggttgaaccctgtctctacaaaaaatacaaaagttagctgggtgtggtggctcacgcctgtaatcccagcactttgggaggctgagatgggcagaggtcaggagtttgagaccagactggccaacatggtgaaaccccgtatctactaaaaatacaaaatttagctgggcgtggtggctcacacctgtaatctaggctacttgggaggctgaggcaggagaattgcttgaacccgggaggtggacgttgtagtgagctgagattgctccagtgcactccagcctgggcaacagaattattccatttcaaaaaaaaaaaaaaatcagaaaataacaagtattggcaaggatttaataaaactggaacccttgtacactgatggtgggaatgtaaaatactatggcctgtatggaaaactgtatggtgattccaccaaaaaaagttaaacataagaattaccatatgatccagaaattctacttctggaaggcagttcagcagctttctacagaactaaacatactctgaccttatgatccagcaatcacactcctgggtatttacccaaaggagttaaaaacttccttccgtacaaaaacctgcacatgaatgctaacagcatctttatttgtaattgccaaaacctggaaacaaccaagatgtccttcagtaggtgaatgactaagtaatttgtagtatgtccagacaatggaatgttattcagtgctaaaaagaaatgagttatcaagccttgaagacatggaggaagcttaaatgtacgttactaaatgaaagaaacctatctaagaaggctacatcctgcaggattccaaccctatgacattctggaaaaggtaaaactatggagacagtgaaaaaaccaatggatgctaggggttggggggagggaggggtgagtaggcagaacacagatgacttttagggcagggaaactactctctctgatgctacaatggagggtacatgtcattatacatttctccaaacccacagaacgtacaacaccaagagtgagccctcatgtaaactgtagactccaggtaataatgatgtgccaatataggatcatcaattatacaaaggcaccctctggtgagggagtgtgaatagtgaagaaggccatgcatgtgtgggggtgggggggaggggagtatatgggagatctctataccttccactaaaactcgctgtgaacctgaaagtgctctaaaaaaaacagtcttttttttaaaaaggatgtttgatagcattagtccttagggaaacataaattaaagccacagtaagattctactgtctcccttttacagcagctaaaattaaagactgaccctgaggtcataagggtcataaggatgtggtgctttaatccaccactggttgagaatagaaaatggtaccaccactttggaaaactgccttaccatttcttaaaaggataaacatgcctaccagatgatccagctactccattcctaggtattttacccaagagaaatgaaaacatatgtttatatgaaatcttgctgacaaatgttcacttttatgaacactttttattggcaaagccacattttgaaaacaatcccaaaatccatgaataggggaatagaaaaacaaactgtgatctatccatatcatgaatacttctcagcaataaaaataaatgattaattcatgttacaacatgaatcagtctcaaaaatagtaacctaagtcagacaaaaacagtacacactgtcaaattctatcacacgtctgttgtccagcaacttgtggggctgatgcacatctcttgggcccaggagttccatctttttttttaaagagaaaaaaaatctacgaaacgcaaactgacatatagtgatagaaaacagaccactgggccgggcatgaaggcttacacctgtaatcccagcactttgggaggccgaggtgggcgggtcatgaggtcgggagatcaagaccatcctggctaacacggtgaaaccccgtctctactaaaaatacaaacaattagccgggtgtggtggtgggcacctgtagtcccagctactggggaggctgaggcaggagaatggcgtgaacccgggaggcggaggttgcagtgagccgagatcacgccactgcattccagcctgggtgacacagcaagactccatctcaaaaagaaaaaaacagaccaccggttccacggagaaaggagagggcacaggaagctcttcctggtgtttgggatgttcgtgatcttgattgtgctgaggattttacaggtacagaacaacttatcaaactgggtggacaaagcaaagaggaatgaaagaggcaacacattaataatgtattatttcctcaattgtctgtaagctacagaaaatctggggtatacctgaagtatatgatgtttattgtacatcggttatgcctcactaatgctttataggagtgagagagggagtaggtggaggcagatgaaggaggaagacaaagcagaaggtattctttttcttctttttgaaaatagttttaaataccccttttaaaaagaatcaccttttgaaattaaactttccagaatatactttaacatgttgttatttcacttttgataatgttccctatcttctatcttcagatagattttaacatgttatttcacttttggtaacgttatctatctcctgtcttcaggcagattttcacaagttatttcactgttgataacattacccatcttccatcctcaagacagatcttcacatctgtctacctcctatctatcttccatcttctgtataaattctgaccccagttcaagattaggtcatttcaatttagtctgaaacttaaattgtttattttgaaccattttacttcctaccattaggattctcactccctcaatgtataatgcctttttatcttttgtaaaaatctgttttaatgatgagcattcctttcctttgccatcttaaattcaatggactctaacatgactccagtttatcccaatgttctgccattcccaagtcactaaccagttactggtgaattaacaagggggatgtaatcaaattacattgctgaatactggccttcctcagatttagaaaactgctcatgtagacgggaaattcactttatgcaaattcaagatggcaaatttatatttacaagaaacaagcatggcttaatttttgtacctttataaatacttgattcattttaccaaacaattatttaaagcaataagctccactgaagttaaaaaaaaaaaaaaaaaaaaaaaaacaaccgtcacagaacatctacacattttccctcttaagtgacagtttctgactttgacagtcttaagccaatgaagtcattctgcatggctgtgccttacagcatcgaggtctggcctctccagccctgcccagtgcattccctggtcactgggataacgaaaagcccatggcaagtggggtgggggaggggacagggactggttaagaacaattgtggtaataaaaatgaaaacatgagaggccgaggcgggcagatcacaaggtcaggagatcgagaccatcctggctaacatggtgaaaccccatctttactaaaaatacaaaaaattagccgggcgtggtggcagacgcctgtagtcccagctactcaggaggctgaggtaggagaatggcatgaactcagtaggcggagcttgcagtgagccgatgtctcaccactgcactccaggctgggtgacagtgagactccgtctcaaaaaaaaaaaatgaaaacatgaaaaagttcctgcatttccagtaacgtgtggtacactccataactgggcctgaacatctcctttcccacctactctcttcctttccgttttttagccactactacatactaaggtacttacaaccctacatgagaacaacagagattctatccagatggtcttacatttgctttcctccaagccattctttcacactcctgcaaaatttaccttccccaaacaacttattttcttcatgtcactcatttcctcatcaacaggaaagaagttcaaatgtgaatggcttctaagacttgcaaatggggcctcaattgcccctacctacaataccacagcattccctctctatccccctccctttacccaaactgtcttactctcaaatccaacattaacgttccacctctgcacttttactgacacttcgcactactaaataggtttcatttttttttttttttgagatggagtctcgctctgtcgcccaggctggagtgcagtggcacgatctcggctcactgcaagctccgcctccaggttcacgccattctcctgcctcagcctcccaaatagctgggactacaggcgcccgccaccacgcccagctgattttttttgtattttttttttagtagagacggggttttaccgtgttagccaggatggtcttgatctcctgacctcgtgatctgcccgcctcggcctcccgaagtgctgggatgacaggcgtgagcccccgcgcccggcccaggtttcatcttttgagaccttacattcctccatggcacctccctaaccagggcctctcatcttctctgcatccacataagggtgagtttaaagtagaattaaaagcaggcaaagaaagacccattgtgtagagaatgttaatactctaaataaaaaaaataaataaagcagcccatattccctgggaaaatgcacccataagatatgtttacctgtctcgctattttcaggcagagagtcatattctgagggacccagagcgagagcgttcatgtctgctgggtccgactcctgcgggtctggcaatgcggcattctcatggccctggtcaccatcaccattggcatccgatcctacaattaggagtttaccccaaaaaggcagggttagaagcataactttctcttaaaacaaagcttacacttgcagtgactcaacttctttagactgtaaaagacctctgggctctcaagcactgccacataccatgacacagttatgaatgaacaacatcttaaagacagattaaaatggcaacaaaagcacaggcctgaaagcagggggctgcacaccacggccatgctcaacttaccctgcgggccacggtctgcgtggtggccagccacctcctcccatgcagcactcacaccgtcagcagcactgcttgcttccagatgtaacacaggagccccccacacttctgcattagggttcagctctgaaaccttagttgctggtacctaggaagaaatgtaagatagacatttgtatccaaatgtcaaccaaatacaattttactcattaatgcagagttaagagacatcagatataggctccaaaggctcagcctatgtatttatacacacctttggaatgaaatcaggttcaaaattaaaaaaaaaaaaaaagcagtcagaattccattaaattccccccaagttttaagttcctcctcccaagaccaaggcttgcagagatggggaaggacacgcctgccaccaaaagattcagtgtttcacaaactatacctgaggaatagctggtgacttcctagactcctaataaaatcacaattcagggttttacaaacttgaatacaaggcagatgaataaaattctaattagaaagcttaaacaagtcagcagggcgcggcggctcacacctgtaatcccagcactttgggaggccaaggcgggcggatcacctgaggccaggagttcatgaccagcttggccaacatggagaaaccttgtctctactaaaaatacaaaattagccgggcgtggtggcgcatgcctgtaatcccagctactcgagaggctgaggcaggagaatcacttgaacccaggaggcgggggttgcagtaagctgagatcgcaccactgcacccaacctgggggacagagcagaactccatctctaaaacaaaagaaagaaagaaagcttcaaaaagtcacataaacaaaaggtgtagaagatgaaaattgctcctaagaatgaaggtgttctaacaggtctgtcagggatactacaggataagaaagctcaggcatcctttgaggaagaagataaaatatctcatatttttcacagaactacctgttcccattcccaatagagcttcagtatcaccttgaaagaaaatccacaggtgaccatgaagctgctagtccagtgttctggacaacggactctcagatcactggggctgaggccaaagctgccatggacagctgtggaacatgggctaaacctcacctggaagacagcacaacaacatgatgcctggcacataccaagctcatcggccatcatgacagtcacgcatgctcagttagtcccacagggcagtcctctactcaaaaccctcccgcatcagcttggctcatttggagtaaaagacgaagttcccactgcagccacagcgccctcctgtgctcactgctccctggccttgtccatttccaggcacactgacctccttgctgtctctgggcacactggcacttttgctcttcccgtccgtctgtccagaacatcctgcccagagactggggactggtggtccttcctgacacagcgaataaacccacaaaagtcccccaccatgtggatactccctactcccctgatttttctgatacaagcctttcttatgcttacacaagcactccccaaagcctaaagaaaagtcaaatgtccaaacacacaatccttcaacaaacttacacatgatttgccttttcaaatgtgccacccaccttcacaccacagtgcaggaagtcaaagcttctggaggaagggacaggtccctggtccccggtgccccttggaatcaggctgcaagctgggagcagttacactgcactaccccagcatgcagcatagacacaccagtttctgcggcccagaacacaggagaagggctggaaaggaccaccatgagccgtcaaataaacgatgggtgcattaacaatttttaaaagacagaataaatccacattggctcaggtgatggggctggtagtaaaaaacatgaaactatttctgaaactgagagaaggcagctgatgtggtttgttcgttcctgctcccccagtcactggagcaccaatgagcaccatgcccataaaaccaggtgtttaaatgagtatctatctggaattctttttagtttttgttttaagtactggtgatagggcaaattattgggttccttcaagaatattataatcaagaagcaccaattcttcaattttccttcttgcattgcatctaaacttcatttttggcctctgcttctgcatagtgttacttgccctcttctctctcatccacccatctgtccaacaagtgcctctgacatgttcaccagcatgcttgtgccaggcacggcactgagctggcaggtgtgatggtgaaggaagcagacaggagctcatggagctacatgagggggcaggagacagccacaggtcacccacaacactgcctctggcagcgtttacgccgctccacctgatctgttgtctttgtaaattcatttctctattctctttcccactctaatacttccatacatcacctttcctaattagacccagtctgttttcaccaccaccacacaatccagttttccagcctcggttccattccatccacttagctggctcccctcagctcatgcacatactacacgtgctttaaattcccaacactaactaacagtaaccttctctattattagtaccttttgcagttgactgtcctatagtaccaaaatacattttgtggtttattaatacagaccaacagcactttgaaagcagtgacagcatggctgttggggctcccgtggccctcgtgttcctcctattccagggtggcagtcaccatgggcattttcctcactgtagtactgctgatagccagcacagtcctgaattcagtagggaggtgctcaagatatatgaggaatgaatcaatgtttaataaataacataaatttatattttccactatttgacaacttctgcaaggttttatgccacaaatgactaggactctacccttaaccaatgactacctcttagtgaagaagtccaaatcaagtgtatgcagttaggaaatgttcaatcaatgctgtgactgaagagatgtcaccaggaatgaaagaatgaagatgtcttttaaggcttaatgacattcaaggatctaccacgtgctgagcacattctacgcacttccttgtactgaatcagaacaagtcttggaggtcgttattcactggactcatttcacaaatgaaaaaaccaaggcagagaaaggtagagtaacttccccataaaaacgatggtaattagaaagttagattctaagcaattgcgttcagcaaaattcaacactcatcaagagttcattaacttataatttatgagaaatagtttgtattaaacaaagatctgaatctcctactatttctataaaatatggttattctcttgcagtaatatggaactctaaatggttatcaagaactccagcgtcggccgggtgtggtggcttatgcctgcgatcccagcatgttgggaggccaagatgggcagatcacttgtggtcaggagttcaagtccagcctggccaacatggtgaaaccccgtctctactgaaaatacaaaagttagctgggtgtggtggcacacacctgtaatcccagctacttgggaggctgaggcaggagaatcatttgaactcaggaggcggaggttgcagtgagctgagatagtaccactgccctccagcctgggtgacagagcaagactccatccttgaaaaaaaaaaaaaaaaaaaaaaaactccagtgtcgtctgcttgactataagtcttatttttccattaaaaatgtatggctaagcaatggttattaaaaccacaggcaagctgaccttaacagccacattccaaagtgaacatgcctgagttctgatgctttaaataaacccttccaccccaccccatcctgtgcgaaacaatatgctccactttgaaaaataacgtatcaattaataagcttgtataactaccgatacgagacagaacagtctctctgacaagttactgactaggaactggagtaattaatgctggagaagggggactggccggtgaggtacagaaagcaggtgagaaataggggaaagaaacattccatgcaagcaccaaccactcctacagatgcactaaaaagcttagtaattcagggcaatttgctgacttcagaaccatacaaggctctacctccagttctttgtgaaatggagtaatagctgctatattaagatttgcttaaaaaaaaaaaaaaaaaaagacacctgtaacagcactttgaaaattgaagctctgaaaggcaaggcaccatcgttaaacgtggtaacgcttcgtatgagaatactgtttgggaatacctcataatggaaaagctaatttaaaactggaagcacacctctcacttaggcatcatttatgctctttgttgatgtctgaggcagtgacactggtaactaactgaaaattatgtcacttctgtaaaagattaactgcagattatcttaaagatgtagttttatactgttttgcctccacaactatttaaggagcaaaactaatgaatttgaacataactctctccagaaaaactcccagtgtgggcacggaaataaaagaggttgatggatcattccttacactacagaaggggatttctacttgtttatttccatatagtaagtgttgacatttgagccatctctacctccttaatatcaatacttttccttgcttcattgcccacaaaaatcatgaataaaccactggttgaataatgagatcttgctactctgagtatgtgctttcaatcacactgcttcgataaatgtctgttttgtggaagaaaactaatttcctgttgttgaatgatgttgacatttattacagaatttctggaaagatgctcaaattagctgcccatagagtcatttgctaagcttcttccaaaccagagggacagccttatctcggggttctgaaaaagaaagagctccacagtaattctaactgcaagaagacagaaccaagatttcataggcagttaaaagcagcaaattctacctgcctcagacacatacaaagatataaggaagcacagatttttaggtaagtttgtcttctgcagtgtgacttataccttcaatgggctcacatgcttatcgaatcaactacactgcccacgagataagatgccctcaaagggctctgacaacactgcggccaggaagacagaagagctggcaaaattcacagacagaaaaaagtcaacacagagctcagggcatgctttagtgctaacaagagtttgcacacaacctctggcttaagtacaccaaacaagaattcatattctccaatttggaaatcattaatgttatagtaattcacagccatatataagcattcaaataactacccactgtttagagtaaatctttattaattttaagttaaaaacaattaaaattggccagcccggtggctcatgcctgcaatgccagcactttgggaggctgaggcgggtggatctcctgaggtcaggagttcaaaaccggcctggccaacatggcgaaatcccatctctaaaaatacaaaaattagccaggtgtagtggcacatgcctgtaatcccaattactcgggaggctgagtcacgagaattacttgaacccggcaatcacttgaacttgggaggtggaggttgcagtgagctgagatcacgccactgcaacttgggtgacaaaagtgagactctgtctcaaaaaataaataataataataataataataataataataataataataataataaattaaaatgtatagcccagcataccgcagcacaatagtaaacacacagaaaacatacttacgaactgtccgtctctatcatgccatccccaaacaacaccgtcctctgacaccggtagctgaggagtgttttctgaaaacaaagcaatttccaaggcctgtggcttatggtgcagatcctcactaaatattgtttcaccttctagagcaccttttgtgactgtattagtccagagatagcccatttgatatccaccacaaccactggccagtctttcagaaaatgctgggtttcctaaccctcccatcgggtaataggaaaattcactcaaaaaacgggagactccttctgggaaactctgccaatccacttttgagggatgttcacatctatttaggacaccttctgtgagtgataaaatgtggccactacttggtacaatcgtgtctttgctgtccacggggacagcgggaatcccctgcgctgcatcgcagggggcacctgtgtatctgtccgctagggtgggatcaacaccaaccagaaagaaattgccactgggagtgtcacgtgactctattttctcaaaactcaccttagcatttcccataaaacccatttcaccatttaaagtcgactgtgtaagagtggacttggcgtttccttctttgaaatggtgtgcacgttcactcgtcccacatggacccaggcagtcagtaattctggggtcaatactatctttctccaaataaagtctctcttcctcttctttacatgttagttttggtttactcaaccctgatgtattattaccaaagataccagaagcttcttcaattgattcagaggaaattcccttccattttgggcttttaccaccactaacagaattctctactatttctgacttctgtataactggattaacacttggactgaaatgtggtaacacactaagaacattatatttgcagtcgtatactcggtgtgtttcataacttttttctatttgattagtttcaaaatcagcgttctctgttgcactagaactaacacaggagagtacatcctgacttggcactgcctcatgtctttgtgtacctgtttcccactcataggttgttttagaatctgacttgacagtctctatgtcatcttcacttgtctcactatactttgcttgcagtgattctttttcactaccttctaacctttgagggtcactcagctggtctcgtgacacactgactgaactcttcacacatatttcaccctctgttttgtcacctgggcttgtttccctctcttcttcctctgtgcaggtgaaaataaatgcggaggaaacacagttactgtgaagagatctggagtgactgggagacttgccatcggggggcactccttgtgccatgctaagctttaggccatctgtcctctgcaccgtcccctgcgtgtccaccacacgctccacacaagtttggtcacaggtctgtgttgcagcctcatctgcttgacaccaagattttgactcaaaagcccttacaccatgaccctcagccttccaaacgccaattctgtcctcttcttggtaaaaggcactattttcagattgcagagacacctcacctctgtctggcagcaggggacttctggcctccaggctgcagtcccctctgcgctgtgccttcctgacttgtctggggacaggttccggctcccagcagtcatcaagctggcttggggctgcttctcttgaattagcgtgacctgagagacacccacttccaaatcttactgcagtgataggcctcttaggacttaaatcaattctatctagaccaacaggaaggatactatctgctttgttaacgtccaagtagaaatcatcgttgtctcttagtggtgtgatagagttattttctctctcctttttagaatgtaaactctggtcgacaacaactgttaccacctccgggtcatcactccctgcaacacatgcagtgtcagtacaaaagctaccaggtgaatgtgcagtgtcagtacggaagccaccaggtggatgatccatctcacttcctactcctgagttacagctctcactttctcccaggacacacgcatgacttagtgagtcactgtccatgttgttatttaattcagggagtaggtcaataccatgtagtgcactactttctgcgtaatttttagggaattcagtgcaagcttctgcctgtaaagcctccatctgcacgttatcagtgtttgcttcacaaggtgcatggctgaacgccacaggctcagggcaaggcttggctttcccactgcattcccctgtcctttcacctggacccagcgtgtcccaaggcgagagttcttcctgccgtggctctggctcgcccgcccctgacatggcacgcgaggctgaaggcactgaagagcaacactctcctcttgcagctactgtgtctacccaggtgcccagctcctctgccacgcttgggcaggcagagtcggcaacacaaatgctgtgaaacttgcactctcctgaatcctgacattgctgatcatcaataccaacagggtttccatctttcctctccctatcggataggtctaaagacttactctcatcaccactgctgaggtgaacgctgaccaccatttctttctctactaaagagtttttacaagtagctgggtaacagtgcagatggccactcacaaaggcttcctcctgcaggcctcggtcagaaggcaccagcacacatgagaaaagctcctcatcttcccaacaaccttgtcggctgccgttacccacacacagtagatcacagaccccctcagaattctgctcattaacaacaatatctgaattcttgtcattctcacccaagttttcataccttgttgagaatgtatatataaaagaggaaagagggttcaatgactgcttgggtctatgaccctgtttgtgcccagaccctgcgaaaatccttgtccgcgcgctaacgccagctacactgctggctccactgccagtacggtgaacctcctcacctttgacggtatcaaataatgaagacaaagttttacttatcttgttttctggttccttttcctccacagatttttgtaacaggccagttttttcactgtcattgtcactacttagttctctgctgaagcagcagcccatgtttgagagctcacaagcacacgacaggcgtgctggtcccaagcctccacagacgcacctcacagtaacttgctataatttctgaggagaagccaacacccagagaccaaaaataaccccttgcacagcggtcacatgttcctgccactcaaacccaaatcctaatgacaacagagcccgactgacagccagcatactccgtgtgcccaattccaaacaggaccaggatccaaaagctcagaacagcagcaagaatgctgcgctgtattttttcttactctcataaactcaataaaacataacttaaaatattatcccagccagaaagatttcaggcttctggtttttctacagtgttccagtatttcccaaattatatttcatgggatggtggtaactaaataaaatagttcataaattcccccaaaggaaaacagtatcagaattttgttccgtaaaatatatagctactcacagttgtatctaattttctagctttacgaaatgatgtctgaaataaatagcaatttaaaaagagacgaaaaaatcaaaggagagcaaaaaaataaatagcaataaaaaatagtatctgtaggtatcaagaaattattactaattgtgtcaggtgtgaaaatggaatgatgtcagttagagatgcatgctgaagtatctgggataaagtgacacattatctacaatttgctttaaaatgccctagcaaatatagtaaatatatacacacatatataaaagttaaaacagtcatgtgcatacagggaggaaaagatttaaagacagtagtccaggccggacgtggtggctcatgcctgtaatcccagcactttgggaggccgaggtgggtggatcaccagaggtcaggagtttcaagaccagcctggccaacatggtgaaaacccgtctctactaaaaatacaaaaaattagctgagcatgggagtgtgtgcctgtagttccagctactcggaaggctgaggcaggagaatcacttgaacccaggtggcagaggttgcagtgagccaagattgcgccactgcactccagcctgggtgacaagagtgagactccatctcaaacaaaacaaaacaaaacaaaacagtagtcgaatgtggcgatgggtaatgttcaagttaatgatgctgcatttggttcatggtattattcgctccacttctgcagatgtctgagcactccaattaagaaaaaggaaggaacaagaaaaaaaagggaaaatagatctacaagctctggtaccagaactagaaagtctcttgaaagtacttgatgcaggaacgcacagcctgccatctggtgaaaaacaggcgttgtccacaactaaacaagttgctcatgtactatgtggtccagtccctaactgtggactcacataatgggtcttgtcttacattgacatctgtgatgttttgcttttagtataagtaattctttttcttattatggttctgacaggctatgtgaaaaacaaaataattcttttagttcctctgcaagagagattttgttgtttctttaacctatgagttatgactggtgtcctattaatgttttactttttaaaaatattaacatttttatgataaaaagtttaggaattacacttaaacataaaggtaacaagaacacttatgaatatactaaaattcaagtactgaaatcatcataatgattatgatgataatggtagtcaacactttatatagcactatgtttcacaaaatattaattacatctatgcatccattttgtcacacgtcttaatttgcacccttaacaacccccaaggtagatactactaattcactgtacagataagggaaatgaggcaccaagaactttagtagcagcttcgaatgacaaaacaaaactcagaccatacattgaccatactgttatgctactcaaagagaattaaacatctacatggcaaaaacgttctgcactaaagacacaaacgattcataccagctgtaaaatgaaaggacatagtaaagcagagaagctcacgagatcacctgcctggctttgagtctcagctccatttttacatgtgtcatctctggcaaattatttaacctctttgtctcagttttctcatttgtaaaatggagccaacaccgacatctatttcaaagagctgttaggcagactttaagtagttggaatagaatctcagagtcccacttcaaagtcccccataatctggccccagcctacctctatgatctcggcttctaagataccattcccccgacctcttctatctcatactaaccaatgccagcacactgcctcaatgttgtttctttctccagtctcctccccacacttttcaagccttgaagtcctttgtgaaaccattctgtgctgctctaacagaatacctgagatggggcaatttataaagaacagagattatttcacacaattctggaggctgagagtctcaagtcgagaggctgcttctggagaggcctttgtgctgcaccatcacacatgtgaggaaatgcagtcactcccaccacaatggcactcatccactcctccacttgtgagggcagagcctggtgtccttatcaccccttagaaggccctacctcccaatgctgctgcacggcggactgattttccaacacatgaactttgggggacacatgaaaaacacagcattccattccagctcccacaattcatgtccttcttataatgcaaaaaatactcattccatcccaatacctccaatagtcttaactcatttcagcatcaacttaaaagtccagagtctcatctgaatcagatagggtgagactcaaggcacaattcaccccaagatcaattcctctccagccctgagtgttgaaagtaacaagttatgtgtttccaaaatacaatggtgggacaggcacacacacaaaaaaattcccgaccaggtgcgatggctcacgcctgtaatcccaacacttagggaggccaaagcaggcggatcacctgagatcaaaagttcgagaccagcctgaccaacatggagaaaccccgtctctactaatacaaaaaattagccgggtgtggtggtgcatgcctgtaatcccagctacttgagaggctgaggcaggagaatcgcttgaacccagcgggtcagaggctgcagtgagcagatatcacaccatcgcactccagcctgggcaacaagagcaaaactccgtctcagaaaaaagaaaagaaaaaaaaatctatttccaaaagggagaaataggcaagaagaagcaagaggtcccaagttcaagacccaacagggcagacaatattaaatattaagcctctctggagaatcatctcctttgactccatgtcccaaccctctgggcacagtggaacagggttggctccccagggcctcaagcagccccacccgatggctttgctgggctcagtccacccagcagctgtcaggggttggagtctcctgcccacagctctcccaggctgatgctgcaagctggcagctccacagtttaaggctcccaggccactcccatgactctactaggcaatgccctggtgggggcttctctgcagcaggttcaactccaaatttctgcttgccattgcccgagtacaggctctctgcagtggctctgctcctgtgacaagtctctgcctgggcccccaggctgtccatgacatctcttgaaatctaggtggaggctgccccacagctctagcattcttcttgcctgaaaaatcagcaccacatggatgccaccaaggtttatgacttgtaccttctggagccgcagctcaagccaccactgggcccactcaagcagcagctgaggtgactaaggagcaatgcacaggatgtggggagcagaggtccgaggcggctctgggcagcaagcctgtggagggcccccagtgctcatctaccaaaacccttctgccctcctagagggcaaatgtgatgggcctgtgatgggggaacagccttaaagatatctgaaatagcctcgccaacacagcaagaccccatctctacaaataaaaattaaaagttagctgggtgtgggggcgcgtgtctgtagtaccagctacttgggaggctgaggtaggaggataacttgagtccaaaagttcaaggctgcagtgagctattactgttctactgcactccagcctgggtgacagagcaagaccctgtctctaaaaaaacaaacaattctgaaaagcctttcagatggctgaaagagctgagtgttttaaattatttccttctggtttctctttttaaatgaaataacggtgccaaatacaaagtatttcctcttgagtttggactctgaagccagattgcctgggttcaaatcctggttctaccactttttagtccagtaatcttggggataaattacttaaacctctttgtgtctcagtttcctcatttgtaaaatggggataacagtacctaggggtaagacaggtgtagggctaacaggaatttatgagtaaacggaagtgttaggagagtgcacagtaagagccatgagagtctgcagtgattaccaccatatgtgatatattcttttacactggagacatttatggagcacctacctgtcaggaagacactggaatacatcagtaaacaaaactaaaccccagatttgatggagcttgcattctagtccagggagacaaacactaaatctaacaaatacctaacattgttagaaggtgctaactgctacacgtaaagggtctgaggcaagccagaagtgaggagacggatgcggatagatggggctcgctgagaaggtgaggccgagactgagaaaggtaagagcataagcctcaaagacttctgggaaaggggcacaccagaaccaattgaggcagagagccctgcggtaaggtgatgctggaatggtcaagggtcaagagcccactggggctggagcagcgtgccagaggagagccagtgggcagcagagtcagagaggacaggtgccagactacgaaggctagggacctgccagaactcaggctaactgtgatgttgagcacaggagtggcaggttctgacttggccttctcgaagggatcctctggccactgtgttagaaaggaagggtgggttggggacaccagtgaggagtgactgcagctgtccaggtgagaagcactggctccatgagatgagaagtccaaacaaaaaatgaagcagcctgaccatctcagaaactctgacacccctgcgtgactcatgtatctcatctacacaagttccctgatttgaagatacacgtttctcctactttcacaatttctataattgtgacatgtcttcgaattgctgccaaaactgaaaattgctgtttcaggatctggcagtggattacctacgtgtgtttattttgcagaaatacactgagttgtacttttacgatctgtgcacatagctgtatgtgttgtatttccacacacatgtaaggacaccggggcctaggaaggcagccagttgccaggcagcggactccgacacatctgtcgcttcctcccagtgatgtgactattctctcagtacaactgtttgcatggtactgccacacaaagttgatttataaatctactattgaacaaaatgccttaatagcaattaaactgaatcctaaaatgaaaaagagtttgcaaaaaaactatttgtcatattctaaatgatgcaaatactaagcaataaaattactaatttttttaaagaaattacaaaatgttctaagttgagagatgtttttactgatcccagtgccttgaaagactactattacatctgtcacacttccacaacaagagaagttttagcagcatgtaaatcatttacacaaggatacaactaagaatagtaagccaaacagagaatgaagaaatccctctatttttaaatatgccttggagctgaaaagatcacgggtatgtgttatagaaggcattccttctgtcagtggccaaaatgctacaatcaaaatgttacaatactatgtcatcaaaaagaaatatcctacattaaaaaggatctactccgtctcagcacgaatacattctaagaggaaaagagggcatctggtcagagtatcccccatcctggggcaagttctccgaagtaccaggagaccaagaaccgtgcatacactctgggggtaaatggattgttttgtcactaaatcatgctgaggtaaaggcagctttacacttcctgacatagtaacaaacatatttctaagacaggaaactgtatcaacatccttaaggaaagttcttaggtcttttgtttttatttttttagagacagggtctccctctgtcacccaggctggagtgcagtggtgcaatcacagctcactgcagcctcgacctgctgggctcaagcaatcctcccccatcagccacctgagtagctgagacagcaggcacacaccaccatgcctgttcttttttgctttgtagatatggggtcttgaactgggctcaagaaatcctcccgccttggcctcccaaagtgctgggatttataggtgtgagccactacatccggccaagtcttttcttttcttttttttgagacagagtttcgctcttgttgcccaggctggagtgcaatggcactatctcggctcaatgcaacctccgcctcccgggttcaagcgattctcctgtctcagcctcctgagtagctgggattacaggcgtgcaccaccacacccagctaatttttgtatttttagtagagacggggtttcatcatattggtcaggctggtctcgaactcctgacctcaggtgatccgcccgcctcagcctcccaaagtgctgggattacagacatgagccaccgcacctggcccaagtctgttcttaaaacagactgacaaggtggtaacaacctgccaaaaggtctaacctgcaagattaacataccaagagcagccacgtgtcacttgcgtacaaatacaggagttggatattttcatagaaattcaagctttctgattgctaagcctactcttattcaaaatataggcctgcaataattaatctgaattgctaattaatagttattcattcagaagctgtgtcatcaaaaggcaaaggtggttttttgaaaactgataaaggaagggactaaagttttttggtattaccatctgtaaaggagtttaaaaaaaaaaattctgggccgggtgcagtggctcaagcctgtaatcccaacaccttgggaggccaaggcgggcagatcacttgaggccagagttcgagaccagcttgggcaacatggcgaaaccccatctctacgaaaaatacaaaaattagccaagcatggtggtgcatgcctgtaattccagctactcagaaggctgaggcacaagaatagcttgaacccgggaggcagaggctgcagtgagcagagatcgcactactgcactatagccagcctgagtaacagagtgaggctgactcaaaaaaaaaaaaatcattctgatatagatgttttgctgaattgtacatagagtttagtatgaggatgagttagatttccaatttcagatttccagtttcacactatgattagaaaagacttgctgtgactttgcatctttcttctgaggaggtaatttaacataaacacttctacctaatattacctgtcccttaaacatcatcattcactcacattcctctctcaaacctgctgttgatttatgataaaacacaagaggatcatttcaacagaaaatggtttccaggctgatgtagtgtctccaagggaaaagcaggtacttggctggtcgcacacaggagtaagaactggagtccctgagtgggcttcaggaggggcaaaaagccgctgagaatgatgtttgctatagatgaagtttgtggcgctaacagggaaggtaaagaacctttaaccaaacgacactgttgctgaataccagtggtcagatattttttcttcctcaagaaggagaacccatcgctgtggcccactgccagtggtcactcttcatcataaacaccctcaaaaccctttcaatcccctctcgccttctatcaccttaccttcaaagccaagatcttaggaggaatgtcaccgtctaagttgtgtctaccactcctgtctctcacccactgcaatctggcttttgctcctatcagtcctgggaaatactcttgctaaggtcacaactgacccctcgctttgttaccttactacacttcacttgagtcagcctccctgcctctatctccaccccacactgtcctctggttttcctcccatccctctgaccactccgcgtcctagattccttcctgtttctgatatattgagggaatcgagagtttcatcactgtccctgcctggaactcaggtaaacttaatgcaaagtactgtaatcataactattggtacgatatacttcaaaatcagtagatccttatgacctcaaggtgagaacattcaaaatgaccttgcttgactaggggcaagataaagagtgcttcttctagactcacctacgtctcagtgcctcccacctccaggtgtacgctcatcttgtacctaaggctcacacacaatgtgatcatgcaatcttgcatgctgtgttagggctcctcgaagacgtgtatctcacgctcatctgaacaacctctccatagaaaatgtcttagccatcatgatcacttgcactcagttttgatgaatggatggatactcaaattttatgcaggcagtactagctgcttgcctaccagacacaatgcattgagctggccacagaagggaacagaatgtggagacacagagcatgtttgtgcctgcccaaggatgctcccatccttagagacagggcctaactataagtgggcctgggggtgggctgggggtttaatggggtaatgtaaaagttctaagactacattatggtgatgattacacaactcagtaaatctactaaaaataattcaattgcatactttaaatgggtgagttttacagaatgtaaattatactttaataaagtttttttttttaatgaacagaacacagtaccagaagtttacagtttagtggagaaaacatgtacacaaatttgagtaattctgacaatcatgtcactcattataatatattgttctcatactaaatagggaaaccatttttttttttttctgagacagagtttcactctgctgcctaggctggagtgtggtggcacaatctcggctcactacaagctctgcctcccaggttaacgccattctcctgcctcagcctcccgagtagctgggactacaggcgtgtgccaccacacctggctaattttttgtatttttagtagggacggggtttcaccgtgttagccaggatggtctcgatctcagggaaaccatattcttacagtctaatagagatcacttttttgtgttctttggctaaccctgtaaatagttactagctcagtaagctttttggagagggcaggaagctgtctaataaatacaactaaatagtaccagtggataaatgcaaatctgctcctgaattattcatgtatttctttgggtatctctattgcacgtctcctcctactcaactctgacagaatggctaaactgtaaatagcctggttcctcaaccctgactgctaaatgtattcacttgcccatcataacaactggctgagcactgccacctaatcactaaaccaatgcaaactcctggtcaactatgaagcatgtaactctccacacctttaggtgcactatgaacaatgctaattagaaaacattcatagcaatgcctacaataggtttctaaagatgtctgaatattatgttggactgaaagtcaaccacggagagaacaggaacttgttgaagcaaacaaactcccttaaagatttatactcaagggatatctactttatgtcttatataattttcttcttagactaccaagcgtcttatatttggatatttttaaaaaatcaatgtgcaccgggcacggtggctcatgcctgtaatcccagcactttgggaggccgaggcaggcagatcacctgaggtcacaagttcaagaccagcctgaccgacatggtgaaaccatgtctctactgaaaacacaaaattatccaggtgtgatggcgcatgcctgtaatcccagctactcgggaggctgaggcaggagaatcccttgaacccaggaggcggaggttgcggtgaccaagatcgcaccattgcacaccagcctgggcaacaagagggaaactctgtttcaaaaaaataataataaaaaaataaattaaaaatcaatgtaaaacagaatacataaaaattttacataaataatatatttataaaatataataatttagaaggtgtcttttgtttttttaaaattcttctttgttacaagctggccaggcatggtggctcacgcctgtaatcctagccctttgggaggccaaggcgggaggatcactttgagttcagaagctcgagactagcctgggcaacacagtgagacctcgtctctatttgaaaaaaaaaacaattggattaacaatccaactcctcaattcctacgtgaactgcttataatggggggggaatagatgagatttatggtaatttttattttttacataaaatatttttactttttaaattttatgcaatttataagatcctttgatcaaactgaatttccagtagtagctctctgaagcactttatatatgcatatgcaaatgatgaaaggtaggatttaaaaaccaatgaattctacttccttattctttcattaatcacagctaaaatgtgaaacaaattttctgagtaaaagcttactattcaatttgtgtggtttaaggaacacaagctaccaaaatgtaaagctactcatccgcatataacagattatcaatgatacaataaaaattttgtaatatttgaaaataaattaatctaaatggtatgctgctgttggcagaactgcacacaaaacagacacgcacagaagctagaaaggacatacagtattgacagttaccatacccaggggttgtggtgatgaatggatcccctaccacaactttttgagaaatatctacattttctaatttttgttacaataaacatttttcttaaggaagtatctctgagccttgactgtgattaaaaaatctgtgattaatctcaaaattgaattacctgactcaaaggtgggatggaacttgtctgagaagtggtttgagatataggaccattcatctgtaaaattgaaaacaaagacaacatcagtacaatgtttaaaaagaaacaacatattttcaaaccacagtaattaggcaaaactaaacccaccaagaaatgcacatttcacatgacaaattcatgaattcataagatattcagaatgtaggaggcttaaaatttttaaattctgaatgaacatcatagataaagttctttgtagattcaatggggaaaactaagaaaagctactttgctcaaagccactttggaactttaaatattactgcttgacataaaatgtttaaatgaacaaaagtagtcaaaaaaatgtatattaaaatcctaactctttaaatacatcctactatagtgactataatgttattaaactatttacaaatcactacatatccttgatttaaaaaataaatggatttgagtatctagagctataacaattttgtttttgttatcatctactacttatagtttcctctactaagctacctctacatttttcagactgatggggctcaggactttctccccaaaaaatatggcacattgacatttgaggaaacagcagaatcaggccatggaaactagaaagaattctccttgccccttctcccttgaagcaggccataaaacacagctgacattcccctgaagacccttccagaggggccctgctctgtaccaggagcagtaacacacagggatgtcaagaaaaacctgaacacaacagccttgctaagcttctccagtttattagctctaggtcacatcccttttgtccaatcatgcttctccacaactgtcaacatctgcattagacttcgcaaaaaaaaaatacagttttccctgtttctttggttcttcctttgtggaggctcccatgtcacatacaacttattactaaataaatgtgtatgcttttctcttgttcatctgtcttttgttgcaggggtctcagccatgatcctcagatgggtaagaaatcttttctcccctacgagactctaatatctgtatgcagatcctaagatgtgccagtgttcctgtttagaactccttactaactccaatatagagtcctttatcaaaaaaagcaatggactccccaccaccccattcgacagcacccaccagatgagcgctgtccttgccctcctggactctctgcgtctgcggttcagccacaaccttagcgtcctgatcagaagtcatgggctccactgggagaagtgtaatgctaacctcaggatgctgtaaaatggcaaagacattaaacaggtcatttgaagggcacagtatgattatttaaataaaattaaaatcctcaagttttccaggacacacgtttatccctctgaattcaaaaaagtttaaagaagtcttcccatatgcataccttactcaccaagaagtgatacttaattttttaaataagtaagtttcttcttcacaccattttggtgaagatggccacactctaaaacttggaaactcatgtgctgacacaaataaacccatttgtgcctggaaactcaagtcttttaaaaaacagaaaattgaaggcttaatatccaagatatataaggaactcacaccactcgatagcaaaataaataaataaataaataacctggttaaaaaatgatcaaaggcatgaacaggcatttttcccaagacaacagaaaaatggcaatagaaatacgaaaaggtgctcggcatcactaattattggggaaatgcagaacaaaaccacaatgatatttcacctcacaactgtcagaatgactattatcagtcagacaagagataacagggcgtggaagaaacagaacctttgcacactgttggtgggaatgtaaattggtgcggccattatgaaaacagtatggaagttgctcaaaaatttgaaaatagaactaccatattatcctttctgagtatttatccaaaggcaatgaaatcaccacctcataagaatatctgcactcccatgtggattgcagcattattcacaatagtcaagacatagaaaccacatagttgtccatcaatggacaaacggatatagaaattgggatgtgtgtatctgtctgtctatgctatggaattatgtattattcagcctttaaaaagaaggaaaccccgtcgtatgctataacatgggtgaacctgaaggatattatgccaagtgaaacacaccagcacaaaaacacaaatactgcatgatctcactcatatgtgaaagttactatcttaaaaagtcaaatacatagaaacagagaataaaatggtgactaccgccgggcacagtggctcaagcctataatcccagcagtttgggaggccaaagcaggcagatcacctgaggtcaggagttcgagacctgtctgaccaacatggagaaatccagtctctactaaaaatacaaaattagctgggtgtggtggtgcatgcctgtaatcccagctactataggctgaggcacaagaatcgcttgaacccgggaagcaggggttgcagtgagctgagatagtgccattgcactccagactgggcaacaagagtgaaactccacctcactcacacacacacacacacacaaaatggtgactaccagggggctagcaggtagggaggaaatgaagagatcaatgtcaaagggtaccaagttacagatattttggatgagtaagtctagagatctgatgtacaacatgaggcctatagttgtaatattgtattgtacactcgaaacttgctgagagtatattttaggtgctcttactaacacaaaagaagggtaaaactatatgaaatgatggctatattaatgggctggactccagtaaccatttcactatgtatatcaaaacatcatgctatataccttatgtatacacaattaaaaaaaaaaaaaaggtcagatgtggtggctcatacctataaatcccagcactttgggaggccgaggcggatggatcacctgaggtaaggcgttcgagaccagcctggccaacatggtgaaacctcatctctctaaaaaatttaaaaactagccaggaacggtggcgggcacctgtagtcccagctacttgggaggctgaggcaggagaatcacttcaacctgggaggcagaggttgcagtgagccaagatcatgccactgcactacagcctgggcaacagagtgagactccatcaaaacaataaaaaatacaaaataacagaaaactggcagggtgcagtggctcacacctataattccagcactctgggaggccgaggagggcagatcacttgaggccaggagttcgagaccagcctggccaacactgtgaaaccccaatctactaaaaatacaaaaattagccaggcatggtggcacatgcctgtataatcccagctactcaggaggctgagacactagaatcgcgtgaaccaggaggtggaggttgcagttagctgagatctcgccactgcactcccacctcggcgacagagcaaaactctgtcttaaaaacaaataacaggccaggtgcagtggctcacgcctgtaataccagcactttgggaggccaaggcaggtggatcacctgaggccaggagttcgagaccagcctggccaacatggcgaaaccccatctctactgaaaatacaaaaatgagctgggcctggtggcacatgcctggagtcccagctattcaggaggctgagacactagaattgtttgaacttgagagagacagaggttgcagtgagctgagatcacaccacggcactccagcctgggtgacagagcaagactgtctcaaaaacaaacaaacaaacaaaaaaaaaaaaacacacacacacacacaaacaaaaacccagaaaattacaaagttaataggactccagaaataaaaacagttgttgatgaatgctaaattcagatatatttaagtgtcctcacttaacatcatcaacaggttcttggaaactgacttcaagcgaaaggacgtgaagcaaaatcaattgtaccacaggcacaaacaagtgttaagctcctacagcatatttccagtcacaaaaatatcaccaaacttctaattaaagacccaaaactccttctaatatttaaaatggcaataaatatgagccacacacatttttaaaagattaacaagaaagacaattacgtacctaattttgggtgagtcagaaagtgacagtggtcatagtggtggtataaccaccactggatttaaccaatcaaggaataaatgtttgcaaagtgaaaactgtaagaatattacggcagggcgcagtggctcgcgcctataatcccgcactttgggaggctaaggcaagcagaatgcttgagcccaagagttggagaccagcatggacaacatggcgacactcatctctacacaaaatacaaaaattagccgggtgtggtggcacgtgcctgtagtcccagctccttcggaggctgggataggaggaccacctgagcccaggaggtggaggtttcagtaagccgagatcgcaccactgcactccatcctagggaacagaataagatcctgtctcaaaaaataaaaacaaaaataaaaaaagaatattcctaccaccaagtagttaaaaaacaaactatgataaccaatagggcaggctcactgagcactatttgttgtgcatttatattattatagtagactttatgaatttttgtttcacaacaatttatattgattcattcatttctcaacctgcttattccagttcagggtaacaggtggccacagcctatcccagcagctcaaggagcaaggtgggaaccatccccgagaggacaccatcccatcacagggccgctcacacacacacccacactcactcactcagactgggaccaggaagacatgcaaatccaccgaacatgcacacctttgggatgtgggaagaaactggaatacccgtaagaaaacacgcagacatggagagaacgtgccaactccacacagacagtggtcctggccaggaactgacttctttctcatcatgttgaaatgacattgaaagaaatgatgtttttcaaagtggttcttcatgaagcatttactcaatccaatgtctagacactaaacttcacatgtaacatctcactcaattttcccaaacaacgtaagaagtaactggctcaccaacactttgggaggctgaggcgggcggatcacctgaggtcaggagttcaagaccagaccggccaaagtggtgaaaccccatctctactaaaaattagccaggtgtggtggcgggtgcctgtaatcccagctactcaggaggctgaggcaggagaatcacttgaacccatgaggcagaggttgcagtgagccgagatcgcccctaaacatactctagcctaagcgacagagtgaaactctctcaaaaggatcagaagggataactgtaacaatcccgtatcctgaggattcctagacatccaggtctgacttcaaggcatttctttttactgcaagctacactgcttcccaaacaagataaatattgttatttaacccaggtatctttttaggtacatctgaaaacatacatcagactgtcagaaaaaatacctttaaaagtgtaactatttttgtcttactaggtagccatacaggtttttcatggtatagtggagctccctattcgcaataatctgcttgtgataaattctcaaaaaccttgttaatgaaataatctgatgatcaaaggcaatctcatccaattgtgtaaactgtatcatcaatcacaaaaacatctaaatgctatcaaaaagagctggaaataaatgtaagctagcagagaaaaaatgcttgaaataaatacgggatgtatgacaaatgttacactttaacagatatatttcattttaatgtatatgtatcttctttttatgtctgtgtagtaccaacgtcttcttattaaacaaagaaaagagtgaatcaatttaaataaatatattaagtactagtataaatgctatcgggactcaaaaagatcttgaaaacagaatgtgagtaactaacttgtagaagacacagatttcgggaacatctggactgagattctaggtccttggttctcaggcctcggatgcaatgaagaatccctggagcaaattgtgattttgcaattttgtagtttggacttttttattattattattattatttttaactatgtagatgattctgaaaaacctgagcaaatacttccaggtgatgttgaagtaacacacgaggggagtagctcccactccctgagggggttttctacgagagaacagatggattccattgtaaaagaaacctacatgtcattaaacatcaattcccacacaaccacgaaatccagaaactaaagacatattaatagtttagcaatcaaatgggcaagtcatagaaggcgctgtggatgcttttgccaacattaatttccagatttttaagattcttatgatagccaaagggaaaaataaaaatcaactaaaataacactttatttaatacctgtatttttttagacaattggaatttatatacctcctgacggaaataccaacaataccatatatgaagtggtcttgcaaaaaaaaaaaagataacaaaaaccaacatgtgatcatgaccctaaatcttattacgaactaaccgcaaatacaagagccaggggaccaccaagggattccacacagtggaaagtttcggaactggcttcttcaacacaaaaggagacgtaagacacacgctggtcagtcagactatggctttacttggataaaggaaacaaaccaactactaaaaaagaaaaacgataatcagagaaacaacagtaaaaggacaactgataatactaaaaaatgattctagtttctcagatgtgataacgatgtggttatgtttaataaaaaggaaaccctatcttttagagatgtatattgaaatatttacagggaaaataatacaatgtgtgaaatcttcctcaaagtactatgtggggcagagaccctgaggttcatcgttattcttccacctgagagaaggaagttcactatactattctgtctacctttgtacatttgaaattttctataataaaaggttaaaaaagtaaccatgccacagtctcagcacaacacagtgatcccgatttgaacactctgcatcctacctattaaaaaaagtaacctttacaccaatatatctcttaattactaatctgacagtttttcaaaaaaggcttataaagttttccaacagaagggattactgatagtcacctcatttaaacagttaataacgtatcattttaatgcttttttaacttacctaatgtgtgaatctaaaatgagatttaaagaatgatacaagtattgacagctgtttcaataaataacaaatattttgttactggttcaagagacctaaaatattttgagatttaaaatatatcaactattgcctcccggcatggcctaaaagcagatctctagattgtaaagggaaatattcaatgggagaaaagaatcctccagccaaagcaaagtacttccacacagccgaccaaggagttgaaggcgggctccgcactcgccagtgccttacaccactcgcaggccttactgaattggacaggaggattttatttaatgtctctttatgtaaaaagcagagaggataagtccaagtgttctcccttcctatctgtggcctctatgctagtaacacatttttaacctcatctgtcaaagctacagtctaaaaaagaagttttatcaaccttgttcaacacttgggagaccataactctcttaaatcagtttctaaaaatttcttttcatgtacaccagaaatgtttattgcatgattaaacagttattatggtctttctagacacacaagacaatcttaaaaatacaacaccatctcaaataaacaactatatgtcaggttggtgacataatgatttagagaaaaattatcgttaatttttttttttttgagatagagtatcgctctgttgcgcaggctggagtgcagtggcgcgatctcagctcactgcaagctccacctcccaggttcatgccattctcctgcctcagcctcccgagtagctgggactacaggcgccggccaccacacccagctaattttttgtattgttagtagagacggggtttcaccgtgttagccaggatggtctcgatctcctgaccttgtgatccacccacctcggcctcccaaagtgctgggattacaggcgtgagccaccgcgcccggcaaaattattgttaatttaaaggacagctatttacgcagaaaaccctacaaattcaccaagagaaatttttttttttttttttttttttttaaatacagagtcttgctctgtcacccaggctggagtgcaatggcacaatctcagctcactgcaacctctgcctcccgggctcaggcaattctcatgcctcagcctcctgaatagctgggattacaggtgtgcaacaccatacccttttttttcttttttttttcccagtagagacgggattttgtcatgttggtcaggctggtcttgaagtcctgacctcatgtgatccacccccctcggcctcccaaagtgctgggattacaggagtgagccactactgtgcctggccacaccaagaaatcttaaaatgtactcagtaggcttgttctttgaggtaaatgttggtattattattttgaagctattttattttacatattgtatatatacatgcctacacatattcacactgaacaggataaagttgataagaatttccttaatgttaggtacacagattttcaacataaaaggagatatgaatacaaaattaaagaagctaagtaaactccacgtggtcattttttaaaattggaagtgtaactttttaaactacagtacaggcttcctttgcaatacaccactattaccactgatatccttttcctattctgggctctgatcttggacctcatgctgtacttagctgtccttccgttgagtctcctttaaactgcagcagttcctcagtcttgccttattcatctacgcttttccagagcactagttaattactttgtagaatgttcctcaatttgagatgagcctgggacatcttaccatgaagcaggaagccatgaagacaactggtcccatcaggaagacacagaggccacagcaaactaagggagggattcccaatagccatgcacggagccacatcaggatcaggaagaatgaacggaaaacaagtcggcagcaatcatgagagctaccaccaccacagtgctcgccttgggactacaggacacccacttattattcccaagatcactaaaggacaacagttatttcaagctgctgttcctcgatgaactgcatttctgaataaccaaaaagctgatcagggcaagaaccacagtcaatggggagtgaatgacaggatcggaaaaatcaaaatatcccaatatctaatacaataataaagtcaataatcattgatgtctgctgaaattatcaagtgaagaacgtgatgggaggtttccaaatggttaagtgagacattgactgaagctatttttcagtattatcattaaaactgggcctctaggcattttatttttgacatgatcaaagactaccatccacaaagtagtcgtgccaaaaaaagagcctgtatttaatcatacctctagatcttactcccaatttaaagggaattctagggaaatacatgttaaatcacaccagcacaaagccatcatctaaatccaaaatgtaggcaagaaagacgacctcatttctatagcaaataaaagatatttaaaaggagagctatttttattgccacagaattaaaaagccttaaccaaaataatccaatgtgatgtaagaactgtgtttggatcctgagtcaaataaattaggtttaaaatgacatagaaaaacttttaaggttgcctaggtaataaagacagagaaaactttttgacatagaaaaacttttaaggttgcctaggtaataaagacatgataaaattactattaattttattgagttccaaccatagtattgttatatttattttaaaagatcttctttataacagctagaaactaaaagactcatgaataaagatatatgtctggaatttgctttagaatatgccaatttttttggtaagtttaagggaagagaagaaacaaaaatatatgaatggtggcaagctgatggtagctaaagctagatgactggtgaactgaggatcactatagtatcctctctacttctatgtgtttaaaactgtccacaataagccaggcacggtggctcacatctgtaatcccagcactttgggaggccaaggcgggcggactgcctgagctcaggagtttgcgaccagcctcgggcaacacagtgaaaccctgtctctactaaaatacaaaaaattagctgcgcatggcggcgtgtgcctgtagtcccagctactcgagaggctaaggcaggagaactgcctgaatccgggaggcagaggttgcagtgagccaagatcgcgccactccactccagcctgggcaacagagtgagactcagtctcaaaaaataaaataaaataacgtaaaataaaataaaataaaaaataaataaaattgtccacaataataagtaaaagaaaacctaacttggatatattatcagtacacacttaagacttcatatgcttatttctatttaaaatttgtattaatgaaataatactaaatgtgtaaacaaatttattaacaatgttcacagcagcttagaaaaaaaaaaatcccatggaaataaaaacgcagaaagtaggctcatgcctgtaatcccaacactttgggagacaaggtagggagatcacatgaagtcagttcaagtccaacctgcctaaccaggctggtgaaaccatgtgtctactaaaataaatacaaaaattcccagctactcgggaggctgaagcatgagaatcacttgaatccaggaggtggagattgcagtgagctgaaagcgcaccactatactccagcctgggcaacagagcaagagtccatctcaaaaaaaaaaaaaaagaaaagaaaagtagaaacgaatgcagtatgttacaattacttaaaatactcacaaaaactgcataaagatttaaaaaaaagacaaaactgtagatactaaagttgcaatatatttataaaaattcaaattttataagtacgtaaaaacaagaaactagaagaaaatatgccaaaagactaacaatgtgtgattaacttattgacttcatctcccagagtctcagttttttaaataacatattatttttattacacgtcttcataaaacatccagcttgctgattccatcagttgctgagtccaaggtcccctgccatctttcccacagaaagggcactgctgcccacgcaggagaagctgcccatgcaggagaagcatctaagtcactttgcagttgtttttcaatacagattaatcaagtgcaattcagtgagcaaattttcttgtgaaactacactgctcagtcctgttcactaagataatggttctcaatgtgtggtgtaggcatagtccagagtcccagaaacacttccagtggggccacaaagtcaaaccattctcaaaataatgcaaagatgttctttgcttttttcactcttattctctcctcacaaaaccacagtggagttttggtatagcatcaaagaatattcaatattcatttatatgaaatgactaccaaaataataaaataaattacctgaggccagatttccttcacacacttcaaccaaaataacacagtactaagagatgaaatgcaaaagcagacaagaatccagccaagattctattaagtcagacattaaagagatttacaaaacatgaaaaaacaatgccactcttcccactgaattattttttgttttggaaaatactactacctttcataaacaatgttatttatattacctaatgggtttgttattattaaaaatgtatatttataatattaattgattcttgatacttaacatagtaaatacagacagagataaaccacagatggagacaaaccatataataaactcaagcttttaggcatcttcagtaatgtttaacagcataaagacgtccttagaccaaaagcttgagaaccactccactaatacaaacccttaaaacccagttctcaaggacagatgcccatgttcatggatggaaagacatccatgtttatgaagaggaagacatcccatgtttacagatgggaagacatggtatttttacaatgccaacaaaccccaaattaagctacagattcaatataatccctatcaaaattcacttttgtgggagaattttttttttttttttttttggcagaaattgctgagctgatcctaaaattcctatggaaatgcaagggacccagaatagccaaagcaatcttgagaaagaataaaattgaaagacacacacacttcctaatttcaaatcttactacaaagctacagtaatcaagccagcatggtactggcatagaccagacaaacagatcaatacaatagaaacgagagtccagaaagaaaccgttacatttatagacaactgattttccacaaaggtgtcaagaccagttgaggggaaaagaacaatcttgtcaacaaatggtgctgggacaactaaatgtcaacatgaaaataatgaagctgggctcctacctcaacatacacaaaaattaaggcaaaatgaaccaaagaactaaatgtaaaagctaaaactatatgacttggaagaaaacagcagtaaatcttcataaacttgtattaggcaatggtttattaattatgacactaaaagtataaacaggaagaaaaaaatacactggatttcatcaaaacgaaaaacttttgcccctcaaagcacactatcaagaaagtgaaaagataacccaaagaatgcgaaaaaacatttgcaaatcatatatccaatacggaacatatatctagaatatataaacaattcctaaaacttataatgagacaaataacccaacttaaaaattggcaaatgagagcccagcgcagtggctcacatctgtaatcccagcactttccgaggccgaagcaggcagattatttgaggtcaggagttcgagaccagcctggccaacatggtgagaccctgtctctacttaaaatgcaaaagttaggcaggcatggtagtgggcgcctataatctcagttacttgggaggctgaggcaagagaatcacttgaacctgggaggcggaggttgcagtgagccaagatcacgccactgcactccagcctgggcgacaaagcgaggctccatctcaaaaaaaaaaaaaaaaaaaaaaaaaaatggcaaatgatccgaacgaacattttcccaaagaagatatacaaatggccaccaagcacatgaaaagatcgtccacatcattcgtcatgagggaaatacaaatcaaaacacaaaataccactttgaaatgaaattaaataaaatgaagtaaatacagaaaattaaaacaaaaatactactttgcatccacttggatgactattatcagaaagataggtaatatcaagtgtggctagtacatacagaaactacaatcttcacacactgctggtacaaatgtaaaacagagcagccattataggaagcagtctggcagtttctcaatatgttaaacaccgagttaccatatgatctagtcattctactcctagggatatatcccagataactgaaaacatgtatctgcctgaaaacctgtatgtgaattttcaaagcaacattattcgtaatagccaagaagtagaaacaacccaaataataaactactaggttaagaccctcccttttttatgtgtgtctggcataactcattggattttcaaataatagcaaaaatcataatttcagaacttgataatttctaagaaaatcaaaataaagaggcatttcctaaacagcaggtaattcttttctggtacgaaagggtaatgtgaaaacacaaattatttgtctctgaatcagaaacctggaaagaaaaagaatgagtttggtaaggattattctaagtgctttctccacgttaccaaataaacttaattctgttaattaggttccatgcctatttagcacagcaggaaattaagatcagggataatttaaggtcacaaagctactaagttcagtgaggctatattaatgcacatataattttgctattcaactatatgtgcctggagatcatttaacaggcaattcactctatcaatccctgcatgtgggtgaatgtcacatcgtaacatgacctcagagaagtgcacctacagtttccttagctcgtcttcattccttcttcccttttacagtaatattcactgcaccaatgtacagatcatgattttagcatgtaaagataagcatcttttttcttacaatatggtacttaaatataagctaaatatttctctttttatacaacaaaaacagtgatttgattcaatgccagactaaaactggtattggatcaattgtatcagtgataatattaaatacattgtaccttacacggggatcttcaagtatattgatgatttttgcattatgggttgaccttagaacagacatttcccatgagagtgtgctgtatgggagccaaatataaaacctctctcctgaatctaaaaacattattctgaagtcaggaactccctactcacaacagattactccctgttctatttgccatgttctgcacattctattgccttttcctggaacacaggtatccctgtgttttatcttctatctacacacagtgatactgagaacaggacagaaatacatatcccaccaatgatatattacaacttaccttgatcttcttccttttgttagtaacattcaaatatatgcagttttactacagtgttgtctaagtactccatttctttatttgtaaagtttgctaagttaccttctaactctaattgtctatgattaggaacaatgagttaagggatgacgcatgaacagagatggacagcacaagatgctcctagacagacatgtgttccaagaactccaacataattttattttacagaccattttacaaaaatcagtaaatgaatattcaactagataagtaaacagaaatttacctaaataaggaaaaagggctaagaactttagagattgccttaattaagtactatataatctccttgggaatcaattagaaaaaatcaaaatgtgttactttcaatgtccaaacaaaatttgtagaaaacagtttaccacccagactttgatccctttgaagctacataaattgatcagaaaaaaaaaaaaatgatcacagaagctaaatcaaatcatcagaagcacaatcatggccaggcacagtggctcacgcctataatcccaccactttgggaggccgaggcgggtggatcatctgaggtcaggagtttgagacaagcctggccaacatgatgaaaccccgtctctcctaaaaaatacaaaacttagccaggaatggtggcatgcgcctgtaatctcagctactggggaggctgaggcaggagaattgcttgaacctgggagaagaaggttgcagtgagccaagatcgcaccattgcactccagcctggcaacaagaacaaaactccatctcaaaaaataaaaataaaaaaatgataataataaaaagcacagtcatagcattctaggatcggaaagaaggatgtctttttttttttttttttttttttttttttttttgaggtagggtctcactttttcacccatgctggagtgcagtggcccgatctcaattcattgcagcctcgaccttctgggtccaagtgatcctcctgcttcagctccccaggtagctggaactacaggagcatgccacaaagcccagctaaaaaaggatatatttcctttttttttttttttttgtgagaagcagtctcactctgttgcccaggctggagtgcagtggcacaatctcagctcactgtaacccctgcctcccgagttcaagcgattctcctgcctcagcctctcgagtagctgggactacaggtgcacgccaccacgcttggctaatttttgtatgtttagagagacgatgtttcaccacactggccaggctggtctcgaactcctgacctcatgatctgcctgcctcagcctcccaaagtgctgggattacaggtgtgagccaccagcgcctggcctctttttttttttttttttgagacggagtcttgctctttttgcccaggctggagtgcaatggcacaatctcggctaactgcaacctctgcctcctgggttcaagcgattctcctgcttcagcctcatgagtagctgggattacaggcacctgccaccacgcccggctaattttttgtattgttagtagagacgaggtttcaccatgttggcctggtttcgaactcctgacctcctgatccacccgcctcggcctcccaaagtgctgggattacaggagtgagccaccgcacccagcagaaggatatatttcttaacagaaattttcattatgattcccacgtgcatatctaaatagagaagtgcagaaaataaaatacaataggaattctagttcctcatccatctgccttgtgctgttagttggatgatatggtttatctcacggctgccagcaccactctgtaatatttgaaatgcacatttttatcttacaatagaataatgtgagagcaccttagggcagattattttatgttccttccatgtaccttatacacatcatatactcaagtgaatctgtaagcttgaatagtgggaacatttacagagcaacagactgctgcttccaacaaaactgttattttagtcttttgtttttttcaagattcagtatctctatgatattccattcttttcgtttcatgttcttatagtaagtgtgtcactcaaagatactgacggataaaagaaatgcgtccaatctcagtagagtagttgtttatacatttaaactggcactcagcactggagtattcctaaggagatgttgccaataaatttcaagactaattttgtaaaatgtcctttatatgtgtacatcggtgcttctactgaaaaaaacagcagtgagaaaatgtgagttttatttatagtttgagttggttctcctcctaaggaggacataatcagacacaagatacaaaaacttatttgttagcaagatctgattgaaaaagtacctacatgagaagaccaccaaataatatactttcaaaatcttcctgattttaaatttagaacgtgtctactaagtcgacacacaaaaaaaggacaacggtcccctccaccgttaaagcctgtgactgggtctacgacattatcttctggagagtacaatcttttgaaaagaccattttagctaggattcttactaaaacataatacaaaacaaccaccgaaactggagtttagatcatctcattaaccctctggctaggagagcattttactcattaaacctttgacgaactcaaaaaccaccactctaatacttggttgtaaagaagctgaaataaagtatctgaaccaaatgcacagaacattgttttgcacaagccctaagctgcagcagtgcgaatcatggccctcggagtaccacttcttgcttttatcccgtgctacacctttcccagtaaagagcttcttaggaagggtttccacaccttttcacacactttcacaaagggaaaagcaaatggaaaagttgacaactacattaggagtatctttttaggacacaagcttagctaattcacacagcttcctttgtcaaatactggactaccaagaagcatcaaaaccaaaatctgcagtctaagcagggcacagctgcagcacgttcacttcatttaacctcaagttgaagcagaaacataaaatcttttttttttttttttttaattttgagatagagtctcactctgttgcccaggctggagcgcaatggtgccatctcagctcactgcaacctccacatcccaggttcaagtgattctcctgcctcagtctcccaagtacctaggattgcaggtgtgcaccaccacactcagctagtttttgtatttttagtagagacagggtttcaccatattggccaggctggtctcaacctgacctcaagtgatcccgcccacctcggcctcgaaaagtgctgggattaccggtgtgagccacggtgcctggcataaaatctttttaatacagatgttaaattacctggttgaaaagctagttgtctcttttgtctagtctgtttagaatatattctaacctccatttttctgtccatcagcattttattccattagaaattacttctcatgttgagaatgtcaacctggacaaacaagattcaacctaacctggcaggatgtgtgctggatgcccaggaagcctctcctgacttgcaagcgtcccctacttccactcttccacatccttcagacccacctgctcactgctgcactcaggctcacttatgccatctctcagccatggactgatctcgcagatggcaaacaaagtatacccagagtccagaggaggaaaaggcaacttcctgttgatgtttcacatgcaatcttaccttttggacaaagagcagaactgcctgattcaatcttttataatttacttttaccttaaggaattgcatatataaacttatcttactgcacggctttaattccattttgaatatgtattttcttgagattattgatagtctccataaaaatctttgcttcctctcatttacatctgaaaacaaaacaaaacaaaaatgctgatggacaaacgtagtagcatgggcatacacctgaactgaggaaaagccagaattggcagcacagcacacagggccttcctcgtcaggaatgcaccttgtagagtacaccgcttcactctgatgggtggaaaaggtctctctccacctcatttccagtggatcctgcatttcttcaaggaatacagatcatgttctattgagctttccaattcatcatcacaaaactacagttttcaattgaaaatacataatactcaaagagtaagatggggaagtggtgagtaaactcattttttagaatggcaaaatgtcagagctgggaagcagctcggagctgctttaatcctgtgcggctcaaatgggaaggcatatttgtccctaacaatgagtcagagaaccatgaaatgatacataaattgattttgttaaaaaaaaaccttgacacgcaacactgacagaatacaagctgagcagcactaatctgaaaatctgaaatctgaaatcctccaaaatctaaaactttttgagcaccaacatgacatcacaagtgaaaaattctgatgtttcttctcacctacgaaaattaaacacaatccaagcacaatgatgcatacctgcagtcctagctacttaggaagctgaggctaaaggattacttgagctcaggagttcaaaaccaatatgggcagcatagcgacactctgtcccctaaaagataaataaaataggccgggtgcagtggctcacacctgtaatcccagcactttgggaggccaagaaagggagatcacttgagctcaggagtttgagaccagcctgggcaacacagtgaaaccctgtctctataaaaaatacaaaaattagtcaagtgtggtgacatgtgcctgtagtcccaggaacttgggaggctaaattaagaggctcacttgagcctggggggcggagggttgggggggcattaagccgagatcatgccactgcactccagcctgggcaacagaggaagactgtctcaaaataaaaataaaaataaaaataaaataaaaataaataaataaaatgaaataaaataaaaatacataaaacacagtgtacagtgaccttttaatcacaacacagcatcataggtggacactgaaaagtctgctgctgctgttatctgacggctgatccaggtactgtggcgatgtcactgggctggttagttacccgagcacatcatttcctcactgtattaatgctatgtcatgttctttactgctgagtactcccatgcgagcaagggtaagaagatgactgccacttggtagcatataaatccagaaccaggcacgatggtggcattaagcaaccagactgtccacatgggtggctgggatggtgacatctttgctttctgatggttcaatgtacagacctcatttcacgctaaatttatttaaaacattgtataaaagtaccttcaggctatgtgtataaggtgtatacaaaacaattctgtgtttagactcggatcccatccccaagatacctcattatgtatatgcaaatatcccaaactccaaaaataactgaaatataaaacacttctggcctcaagcatttcaaataagggatactcaatctatagttataaaaatgtcttcctcaagttattaatacagccctggaggcactccctaaagtcttattatctgaacctgcaaattaccttccttaataattaaatgccatttaacagtgttataagtggtgataaaatacaccttattttacacatgcattaatgtgaagtcctcctttcttgaatttaatattcctaatatatacgtatttcttagcatttcagtgaaagggaaatattccataacaattataatcctatatagctcttgaaaatcacacctcagaagtcaagacaaggaatctaaatagagcagacataaaacacttgaccgaagtcaggatcctatcttcattagtccctccatgcccagtctagatcccatttactcctgtctttgcaattatgtttttttccattatgttcaatccttccctgtcactgtttcaacagcttattctgtcgcaaaaaaaagaaagtgaacgtggggaggggaggagctgaggagcaagggaggagctgaggagcaagggaggagctgaggagcagggaaggagggcagaatcagcaggactggacgtcctcctggcctcctgctgaagaggcagctctcaactgtttctatctccaacctcccagaaaactttccttctacaagaaccagcctcctgcttgctggtggacagggaggacctctcacagcacagtggaacagaccagcctttcccttgaagcccactctaccctcttccacttcgtcacctgctttctcagcctcttgggaatgctcttctgcactaagtagggcaaaagctctcttgccctgtgcaatcaaaagaaatagtaaatcaaatgggcaatcataaagatgaatacataaatctttagctattttatacatcttcattcacacgggcctttttctgagacttggtcaattagatattatttctttcccacataaactatatccataatgcatcaacaaagatcttcattgttttttaaagtgcagctgagagacaggaaaaccctctgaatagtacaatgcttctatgactcttcttcagtttttatccttattttcatatctaattcatcagcagtttctctgtgatttgtttttgagatactccaaagttttcaaatgagtaactgcttttacactattttgatcaatttatattaattaaatcacacagctgcacgaatgagtatgatcgatgaacaagtttggaagctgacctggctttggtaagcacacaactccactggtgggaagagggaacagccctgctgaagagaagcccagcgccagtgtggtgcaacccacaggtatgcatggatccacagacagcgttgatcctggtgacaggccacggtatgtgtgcaaaggagtctacctccttgtctccttgagttatgctcctgtgctcccagtttctcatggcttctgttcacaaccatatgctcagtttcagcacaaaattatctaagtgaatgcccagtgaacaccttatgatcctgcagagttctcaaaatcaattccctacttctcatttaaaacaaatacgaactgataaccaatctctcttattgaaggacatatcattgactcaggtgcccaaggcagaaacttgcaaatacagctttaacttctgctcaagtttctatccctgtcatgaaactgtgcagaaaaccaccaactgaactgaattaccacccagtttcttaaagcatctcccttcttcccacctccccaaactccacagattcttccagactgccctccctaaagcgagggactcgcaactgaaaccttctgacaggctgcaccaggataaagtgaaaagaaccacagctactgagatgctctccccatcctcccacaaagccttggttggttattctatgtactcctgcaaacctttacacccaggaatacagcatatcaaattatcatcctcactccaacacaaaagttttatcactcggaggtcagaaatatgtctaccctgttcactgttgtatccctaacacagtacctaaacgagtaaaatctcagtaaatacattaataatttattatcttgtggcaacaaatgtgggaaaaattaactagcatttaaaatatgaagcccagaaaatgggatgagtccaaagaacggcctctgctggtgcacattccaagtggtgtaataagggaaaaggcaatattcacagctgagggcaaaattactttgagttaattttcattttcattttattttattctctagactttgtatatgcatacatgcatgtccgtttaagtgtgcacctgggatctaaacatacaaaggagttaaatacaaagtgatgactaaaaatttttattgtattatcaaaacaaatcactaaagaagttccgaagtggcaaacacatactgaaacaattatttgtattgggggatgtgagatcgtgaaatatatatatttggttttcctcccatttcatggcatagaattcttaaaatccctggaatctcccaagtaataaatgtctttttgtatactaatgatatgactgggctggcagtcctaaggtgttttcaggatgggaactagtcaccagaaagaccgaggcagaattagactgttgggactttcagcccactcccaatctccaggtaggggaaagtggcagaaggttgatcatcaatggccaatgatttcagcaatcatgcctatgtaacggagtttccacaaaaaccctaggctgggtgcggtggctcacgcctgtaatcctagcactttgggaggccgaggcaggtgcatcacctgaggttaggagttcaagaccagcctggccaacatggtgaaaccccatctctactaaaaatacaaaaattagctgggcctggtggcgggcacctgtaatcccagctacttgggaggctgaggcaggagaaatcacttgaacacgtgaggtggaggttgcagtgagcctgagccaagatcatgccactgcactccagcctgggtgacagagcaagactccgacccaacaacaacagaaaaaggactcggtttggggagcttccagatagctgaacacatggaggttgttaaagagtggcagcccaaagagggcatgggagccccttgcccttcccccacaccttgccccacacatctcgtcatctgcatcctttgtaatatccttcaaaataaaccaggaaacatgttttccttacttgtgtgagtctgtcaagcaaagtaatggaacccaaagagggggccatggggatcctaggaagcatgggtaaacaacctgtggcgtgggagtggcatcagaaggggcagtcttgtagggatgagccctcattctgtgggacctgacactatctccaggtagagtgttgagactgaaggggagggtgccccactggtgtctgctgtaaaactgattggttgctggtggggagaaatccccgcacatttcttggtgaccagcggtcacagaattcttctgggttgattgttgtgacgcgaaagcaggagaaaaaccgctttttcttcaggagggaaaggtcaaaaaatcctttccaaaatatactgaaagctatgaaacagaattcagaagttccaggactcctccaagttcatctacaaacaagaaaaggaaacgtcaaggagtgcaggctgcagcacggggggggcctcccttgccaggtggtgaggggccgacccacctctcctcctttgggggacacctgaaacagatagcacaatgcctggcacacagcatgtgttacacaccacagccaaacggcaggcgtgggagctatgaaattccaagttgcggccaggcgcggtggctcatgcctgtaatcccagcactttgggaggctgaggcgggcagatcacaaggtcaggagatcaagatcatcctggctaacacggtgaaaccccgtctctactaacaatacaaaaaattagccgggcatggtggtgggcacttgtagtcccagctactcgggaggctgaggcaggagaatggcgtgaacccgggaggtggagcttgcggtgagccgagatcgcgccactgcaatccagcctgggcgacagagcacgactccgtctcaaaaaaaaaaaaaaaaaaaggaaattccaagttgctcagagagtcaatgtcactgactccaagcacagaatccaacaacaatcttcaaatattaggcattacacctgcagaccagaattgtttcccagaaacaatgcaaactgtttaatattaaaatatagtgaatgtcccctaaaattgttacttacaaaagtactttttacaaaagagaccgggctctgtggctcatgcctgtaatcctggcactttggggggccaaggcaggtggatcacctgagggcacgagtttgagaccagcctggccaacatggtgaaacctcgtctctactaaaagtacaaaaatttggcaggcatggtggcaggagcctgtaatcccagctactcgggaggctgaggctggaaaatcacttcaacctgggaagcggaggttgcagtgagctgagatcgcgccactgcactccagcctgggtaacaagaataaaactccatctctaaaaaaaaaaagaatttaagttccaagattttttttttaatcttactttggtttactattccaaatgacaattacctaagacatagcagtaccatctccatcctataaacaaattggattacaattacaggccagttatggttatatgcctacttcaatagacaatgtgactgagaaaagaaaaacagcttagtgcagttgagctatgtgaggtatgcaggcccagagagccgtgagtgtgggacttctgtcatgcctcccgccccagatccatgctgagcagaattgtttagtcattttgttcctgactggctgccttacccttatcttcatgttcctgaaatctatgacaacgatgaacaatgtacagccaatcaatagcttatgttattttgatgtacattttttgtaaacaactcaggaactgccttttttccctttaaaaatctacttccaacttctgctaatggggtgtatactcagagcaacctgaatccatacacctgggctgcaatcctcaggcttggcccaaatcaactctctacttatattaattttgcctcagcttcttccttttaggctgacatacgtgatgtaagacagcaggattcagaatgtctcccctcaatcacctggtttttctgagagtggcgctgggaaccagtgtgacactctccatcttcagaggtctcatgtggtgttttgtgtgaggtctcctgaaattggaactcccattctttggctgaacatctagattttacttggactgtttttcaaactccctctttcctttaagagtgagggctttgctgtctttggacaagagactggggtgaagagttccgcagacaactgccttctttctgcctctgcctcagggccaggattttgggtcaaggtttttccacctctgctcatggcagaggtttgggataaaggactggcagatactggtggttacgttttatagagcatgcttttaagattgcagctgttttctatcatttgaaaatctgggcttagcctttcatttgtgaccaactcctgttagtttcctactgaaaagcacacagcccttttgctcctccagatgggtgtgagggtctggtcccccgtaccctgcttgagcactcccgtcccctggcagttagggacagtccaagtcacatcacacttagaccctaaacacattcccagccatttgtcacttttcagaagttagtaaattatacaaaattggactttacaatctgagcagtctttgtggaaacatcagctggatgtgtgtgcacttagggggcactctcttacatttagaaagtggagccgcctaacacaggacagttgtgagcagcagtagccaaaatgagcatcctttaagtgtctaaaataattaatctgtgtacctaattgggggaaaagttggctttagaaccagagaaactaaatgggaaacgtactttatgtttgtgctgaaatctgatgataagatttgaaaacattctttttcagagttctacggtcagaagtataaaaagctgatactttggctattgtttttttggaaggaaaaaaaaagcctttctgctttttcctcttttggatcctgtttctgggaactcttttcagtcaactgaaactcaccttaaaatgtgtttgatccctgtttgcttcctgtcttgttggtatgatttttgtggaggaaaatacaaaacttaatttgcctgtcagaaagcttaagatcttcctaaaatggttcctctgagacttgttctgtttccttccacacttctactccttctttttgccatatttgatacatgaagaaatctagaggacacttctaatgactctgagacccgcttcggaacacaggaagaggcaacactcacccccttctggaagggtcttctgttttcagtacggagtctgaagagttgtgagtagtttcctctcaggtctaaagctctgctcccttttgcattgcgctgtccaatttcgtggttttcgggggctttcgggattactttacactgtgagagagaccctgacttttgtgtgtgcaatggcggacaagtcactggtgaaagctgcagtttgggaagtggctgactgaatagttgttactgcaggatggctactgtttctttacacatttagacagatgcagtttgaacacttggaggttaggagagtgctcaccaccaagtgataagattcccatatgggatgggctggtcacagtgggctgactgggccactcaccaaccttgagggaatgtccttgcagtgagaagcactgtggaagctctgcgtggcaggtgttatggcgtttccctcctttgggggacccaagattcagtctattaataaaagtggaatccttgatttttaaagatgtagatcaagggtgtccaatctttggcttccctgggccacactgatcttgggccacacataaaatacactaacactaatgacagctgatgagatgcttaaaaaagagagagagaaaagaaaagaaaaaaaaatcgcaaaaaaaaaaaatcttcatactgttttaagaacatttacaaatttgtgttgggccgcattcaaagccatcccaggccgagggtaggacaggcttgatctagatgctctgcctttcatctgtgcctgcttttcaaatttaagtattaggccctagaaactgcaaatgttttctttttccactcattaaagtcagtaatctaaccaagaaacatctaggttggaagaccacctatctaaccagactgctctccaatatatgacgttctatggccgagcgcattggctcacacctgtaatctcagcactttgggaggctgaggcgggcagatcccttgagctcaagaggtcaaaaccagcctgggcaacatggagaaacctcgtcttgacaaaaaaaaaaaaaaaaaattcaaaaaaaaaaattagcggggcatggtggcgtgcgcctgtggtcccagctactcgggaggcatcacttgagcctgggaggcagaggttgcagaggtcactgcactccaacctgaatggcagtgagaccccatcaaaaacaaaaacacaaaatatgactttctgacatttagctagctatcctgaacctctttataaaagaaactgacatctgtaagggcatctcccttcctgcactcaagccactataaacttttacaatgaaaaaaacattggcttaaagtttacagagcaaaccttccctttgcttgatgcttttcctggcaattcctgactatccctttttgattcaacaaataatagtgtttagatctaagttctctgcctttgggatgtaagttttcacctgagagtcatgtctttggaagtgaaaatttagggttgtctagcaatctgaattgtttaggggagtggaacagataattaagagactgatagtctaaaggagggggggaattattttcactagcaaatgaaaaatcttataaaactgtaagatctgcttctgttagtgcatctgcatgtctttacttttatgtatcatatatatgtgatatttcactaccaaaatatatgaaacacctctaattaaccagcttaaagaaaacacaagtgcttaaatcaaatatttcatcagacaaatagaaactcaaatgtcttttagttcatgacttgggtagatctttggtaaataaagattagtttgttggtttaatgaaaggagctatgtcttctcatcagcaaatactcattcatttaactctagggtttcacaggctgtagaaatgattaacaaagaaataaattgagatgatggctaactttgtttaatgaactattcaagcataataactgttaagaatgaataaattagggccgggtgcagtggctcacgcctgtaatcccatcactaggagttcgagaccagccaggccaatacagtgaaaccccctctctaccaaaaatacaaaaattagctgagcatggcagcgcacgcctgtagtcccagctacttgggacgctgaggtgggagtatcacttaaacccaggaggctgacgttgcagtgagttgagatcaagccactgcactccagcctgggtgacacagtaaggctgggtctcaaaaaaaaataaaaataacgaagaataaattagatgaatgtaaataagatatttataaacaaacttttcatagtttcacaaacccttttcaaaaatttaatcttaaagccatgttatgttaattaacaggtaatcataaaatatctatctcatttatagggtacagaaaagttaaatatatttaggttataaacaaaatatatttaggttataaacaaaaattgaggaaatattcagaaattgttgtcatgtggtataaaacagttcaaaattacttcctgggtttttcactggaaattcgagttactaagagttaaaattgtagttaatatacgtaattaaaactattaggtataagaaacaattttatatacagagcatattttaaaagatgtaaggaaagttgaaaagagactaattgtttttcccttgtacacagagatctttgtatggtcaaaatgataagggggaaaggaaagtaagtttttctcttaaggtaaaatgccaatataaaaaagaaaggtaggttgcagtgagccgagatcacgccactgcactccagcctgggctacagaggaagactcagccaaaaaaaaaaaaaagtcgagtgaggcgtggtggctcgcacccgtaatcccagcactttgggaggccaaggtgggtggatcatgaggtcaggagttcaagaccaacctgaccaacatggtgaaaccccatctctactaaaaacacaaaaattagctgggcatggtggcgcatgcctgtaatcccagccactcgagaggctgaggcaagagaattgcttgaaccgagacccgggaggcggacgttgcagtgagccgagatcatgccactgcactccagcctgtgctacagaggtagactcagcgccccacccgcccccaccgcccaccccccagcaaagaaaaaaaaaaaaaagaggtataggtcaaaaccaaaggcttcagcaagttgtagaccatttgtggaagattaatcttgtgaaaaaaaaattgtgtgtaatcaagcttgctaaattagaagagaattatttagttttgctaaaattgaacattaatatacaacgtacacaaatgcagggccagagtctgggcccctgtgtcagaacagcagacttttcttggagcactggtctgctctttaagaaaaaattttaagtggttgtaaaaagtttatggaaattttatcttgcatggtccaagctgattgagatttgatggacagtttcattaaaatagctttatactcaggaggctgaggtgggaggatcacttgagcccaggagtttgaggctgcagcgagctatgattacaccactacactccaccccaggcaacagagcagaccctgtctccaggggaaaaaaaaataaaaggctctagcactgacaatatactgatgcaaaggtaaaatttatttttctcttttgaacaagatgttcatataatattaatgaggataacaaaagacttttgctcaccttttgaataagctggaaaaaaaaagattctgttggtctcatgtcgtctttttaggtcttttgattgtttagaaaactgagtatcaaaaaagagaaaaagtttttgtttttttggccgggtgcagtggctcacacctgtaatcccaacactttgggaggccaaggtgggtggatcacgaggtcaggagatcgagaccatcctggctaacacggtgaaaccccatctctactaaaaatacaaacaattagctggatgtggtggtgggcgcctgtagtcccagctactcaggaggctgaggcaagagaatagcgactcaggaggctgaggcaggagaatggcgtgaacccaggaggcggaggttgcagtgagcccagatggcgccactgcattccagcctgggagacagagcgagactccgcctcaaaaaaaaaaaaaaaaaaggtttttgctttttgaaatatttcaattatctggctaaatgactattattttacagcaacctgtgattctgttttgaacaacatccttttcaatatttgacacatttcccaaaatcaactttcaaattctaaaattaagtcttttccaaaaggaaccccctggaagtccgagagagacctattaggcttaattggtatgttaaaattgtatgtgaagctttgtcaaataagaaatggtgtttaactttgggttatatttgtgtgcatggtattaatgtgtgttccaacgttacatgagatttctgaaatcctgatatgtcttgatatgtcagacataattatggttattatgttaaattgttgtatgccacaaaaataaccaaatttccttgtaaattgtgtctttaactgtagctactctaagtcttttggcatccacagacaattattgttctactttgactcttctcaaaaagtagtttacacttggctacagtcaaaaatttgctttttcttcaagggaattcatggaaaataattttttttttaagagacaaggtcttggctgggcgcgatggctcatgcctgtaatcccatcactttgggaggccaaggcaggcagatcacctgaggtcaggagttcgagaccagcctgaccaacacggagaaaccccatctctactaaaaatacaaaactagccaggcgtggtggcgcatgcctgtaatcccagatacttgggaggccgtggcaggagaatcacttgaatctgtgaggtggaggttgcagtgagccgagatcacgccattgcactccagcctgggcaacaagagtgaaactccgtctcaaaacaaacaaataaataaagagacaaggtcttgctctgttgtgcagattagagtgcagtggcactttctaactcactacaacctcaaactcctggacctaagtgatcctcccacctcagcctcccaagtagctacaactataagcacacaccaccacacctggctaatttttctattttttgtcgagatgggggtcttgctatgttggccaggctggtcttgaactcatggcctcaagcgatcctcccttcttggcctcctaaagtgctgagattatagctatgagccactgcgccaggtggtaagtactcttgaatacaagtttctgataattttgaagaccattatcattggagtaagtaaaaactttcagaactctaataaactgttgtgttcatgatgattgctaactctgtatatcaagcagaataaaacttaattacatgggactgaaattacagatgactgaaatgattttgacgactttttgtttgaaacattgctgattcttttcatgttttgttttcccaagtcgaggaagcttttttctttcaagctttttatagcttgtagcaaatgggtaaaacataactttatgagcaagactgaaacattcaccttactctctaccttatttctccaaaatgtataaactattcatgagtactcttattttatgacagtctaattatatgcgttttaagttcaataaaaaccggtttattgtaacaggacacaattaagacactggttattctaccgacactcttgactggaatggcgtattttaagatatgaccagactggtttaaagaacagaggttgactatgtagagccaataaaaagcctgttggaaagactagcctggtaccttgtttacatggctcctttacaaggttcctgatgtgcagcaagtaaaacaatcttactttctgacaagcccaggaacctcaagatattttgcgacctcaagaagagaggaattcacccaattcatgtaagtattaccagcatagtccttggcttggcttcctagccttgaggctttatagttgaatccaaaattccttatgaaagttccagcaaagacaacttaaagaacctatatggccaatcattattcttgttgcattttatgcaaataatcagcccaagtataatactaaaacttattttgcaagtaagctggtcctcctaagatttatatcttcagtaaaaatggggactggagagagaaaaaattatgcttcataagaaaactatagtacccatgttattagattccagccttaaccattgtgtttgagtttttattgttttcctacaatttggattgaatctccaatgtaataggatttttactatgtattttattgttttacctctaagaaaaccaaaagcatgaaattcaaagactacagaagatttaacaagcaatgacagttacataaatcagtgacttgactgagggctgagaatgagccttcccagcaccgtcatacatcatcccatcataaaaatccacttgtaactgccgctgagcaacttggtctatgctcctgggttgcaatcatcatgcttggcccaaataaactcttcactcagcttcttcattttaggtcaacactaacatcacaaaaagagtttcagacaggccggggatgatggcacatgcctgtaatcccagtgcttttgaaggccaaggcaggaggattgcttgagcccaggagtttgagaccagcctgtgcaacaagatgaaaacccatctctacaaaaaaatacaaaaattaaccaggtgtggtggcacgtgcctgtagtcccagctactcgggaggctgaggagggaggaccgcttgagactgggaggtcaagaccacaataagccaagatcacgccactgcactccagcctggcaacagagtgagaccctgtctcaaaaaaaaaaaaaaaaaaaaaaaagtttcaggcaaactataagaatcagccattgaaaattcctatcacttccaatgattctgaattactgttcggaaatgtagataactttactcaatcttgtagcataggatatctctggcttcaaagataaccacaatgggccaggtgcggtggctcacgcctgtaatcccagcactttgggaggccgaggtgggtggatcacgaggtcaggagatcgcaaccatcctggctaacacggtgaaaccccatctctaataaaaaaaaatacaaaaaaattagctgggcgtggtggcgggcgcctgtagtcccagctactagggaggctgaggcaggagaatggcgtgaacccgagaggcggagtttgcagtgagcggagatcaagccactgcactccagcctgggcaactgagtgagactccgtctcaaaaaaaagataaccacaatgaaaattactattaatactttgtttaacagtaattattcaactattaaatatttaaataattaagttattaaactattaagtacagggcctgtatctctgatgctgaactatgatgtgtgacttaagcccccaaatacatcatgttatttggatccaaggtgctgcacagaacgctgaccctctctaagagctgggtattacttgcaaaaggcttataagcatcggtgcatgggtcgttcagtggtagaattctctcctgccacgcaaaaggcttataagcaagaagctataaagttcccattttctgttcttcctgtattggatgatgtaaagcaaactgtcaccaagactcagtttcccaaacagtaaaacaagtgttctgaagaataaatggggggaaaaaagggagggggctttcaatcctctgaattacaagtccaatacattgttgagggtgggagttgttgcaatttgctgtagtttcttaagagtgtaagatagtgtgaaagatcctgacacacaccacagttgcctgaggacagtaaaccaaaggccaggagagctcacagcaagtcacattatctctagtgtgagttcctctacacaaaggtgacgggtatgaacacaggtgttgaagttggatccaagactgcacacagactcctgtgttaacagcgtggacgttaaaatgaacaactctccctgaatgctttaggaagaaaaccatttaatttacatgaatttctcttagactatttctcaaagatgaactgtaagctgcagtctgattacacgatacaaaccggagggtgttaaccagaacaccaattagcacctccctatttggattaaggttaatggattatctaaaatgacaaaacacttaattttcctggagtaaatatatttcaatcttttaaaaagcacagtctaataactgctttaaaaatctacctcaaaaagttaaaacacttatttaaattatctaacatacataaaattaatgctttcaccaatttcttttgatataccacagcggagggtgcgccttaacagcgaccacagtaaactctgcaattacagtgcaacgggatgctggacttaaagaggaggctcgttacagtcctagctctgtcaccaactagccagctgtatctctaattaattttacctcatgggcttcagtttctgagtcttcagagatctaaaatcctaagactgcaactgcaatattacactgtttttctgacaattattttcacaaactagttaccaaatctcagttgacaaaataacgtagaacaaaactcacagtcttagaatataaacatcttacttcaaaagtactatttaattcacacctaacattttatgaattaagaattaatcaggccagacacagtggctcaggcctgtaatcccagcactttgggaggccaaggcaggcagatcacttgaggccaggagttgcagaccagcctggccaatatggagaaaccctgtctctactaaaactataaaaataagctgggcatggtgacgtgcctgtagtcctggctactctggaggttgaagcacgagaatcacttgaacccaggaggtgatgattgcagtgagccaagatacagccactgcacttcagcctgggggacaaagtgagactctgtctcaaaaaaaaggaattaaaaagaattaaaggttccttcagtcttttaattccagactgataacgatggaactgataaaaagaaaacactccatgcaactgggttaaggctgattaaatgttatgttcactattattattattaaacatttcgtaaatatatgctttacaataaatttacctaaccacacttcccaacatcaaattgaaaactggaagttaagggtcaggcatggtggctcacacctgtaatcccagcactttgggaggccaaggcaggcggatcacctgaggtggggagttcgagagcagcctgaccaacatggagaaaccctgtctctactaaaaatacaaaactagccaggcgtggtggtgcatgcctgtaatcccagctactcaggaggctggggcaggagaatcgcttgaacccaggaggtggaggttgcagtgagccgagatcgcaccattgcactccagcctgggcaacaagagtgaaactccatctcaaaaaaaaaaagaaaaagaaagaaagaaaactggaagttaatgatccagcatttatttgccttgctcatataattatctaacacaatttgtggccatataacgattttgggaaaacatctagtctacagttatttatgttgagctgtaacttcatgtgatttcatgaaaaacctattctcaataacagaataaaactaccacttctttctttcctgtaaggttggcagggggacgcggggagggggaggactaccacaatgaccaacacacttccaaaattctgaacttacaggaaatagtatgccaagaatctgtgtggccttgcctgaaagataataaaacttgtggtcactcggaatcctaaggcacactgcaaaagtttactcttcactggaatttctccaggtcatggagatttttaagtgcctcaatgcttctacagtttatttggcaattctacatcccatttccagtcctttcatgcttaggtttaactctcctgtactgagccctaaagaataatgatttcagcagaagagattaaattcatcggtgtgtacaaagaaatgggaagagcagggaaaaactgaaggccacgtgcacacgcagcaacactggtaatactgcttcccatattcattctttggtcttcactgacagcgtgaagaagcaactattgctgattcatcagttactcattttcacaatggtcagtactccaagtcagcggtaaccaatcttttttggcaccagggactgacaggtttcatgcaagacaatttttccacagacagagcggaggggtcagggggtggggggtggtgaggaggatgctttcaggatgaaactgttccacctcagatcatcaggcactagattctcataaggagcatgcgacctagatcccttgcatgtgcagtgcacagtaggatttgagctcttatgagaatctagcgcaactgctcatctgagaggaggtggagctcaggcagtaatgctcactcaccctgctgctcacctcctgctgtgcagcgcagttcctaccaggccatgatgggtacgggtcggacaacctgggagttagggacccctgctccaagtgacccactgaaaggcaacctgaactagcaatttagcctggtaacaactgtcaatggagcaaggcacaggggctcacactcatattcccagcaacctgggaggctgaggctggaggatcacttgaggccaggagactgaggccagcctgggtgacatggcaagacctcatgtctcaaaaaattattatttaaatagccaggaggatcactggagctcagaaattggaggctgcagtgagcagtggccacaccactacactccactcctgcagcctgggcaacagaacgagaccccgtctgttaaataaataaataaataaataaataaataaataaataaataacaagtatcactggaggtatggatattaaccacagaggaatatggaacatagaacttaaaatcatgctacgcaggccgggcacagtggctcacgcctgtaatcccaacactttgggaggccaaggcaggcagattgcttgaggtcaggagattgagtccatcctggctaacatggtgaaaccccgtctctactaaaaatacaaagaaatcagctgggcgtggtggcacacgcctgcagtcccagttacttgggaggctgaggcaggagaatggcgtgaacctgggaggcagaacttccagtgagcggagactgtgccactgcactccagcctgggaaacaggtgagactccacctcaaaaaaaaaaacaaatcatgccagacagaagtccacccaaaaagactttcacagtaagctactgtatttacagtactcaagaaacactaaatgccagtgttctatccgtggtttaaatgtttttaacctcctaaaagcacaagagacaatgctttcatcctttcaaatgtctagatttttagaaggtagcttcccatagggacttcaagtctacttttaaagtcaggactgaatggttaaagcaatgaactagaaatccattggggtttcccggcacaggtctgaatcctaccaattaccgcatcttttcctttgcaaacgtgatttactgacccctcctccagatggagagcctggtatttactacctctcaggaagaagtgtgactgctccccaacctgaccaaactttccccctttatggacccagtaaaaaaaaaaaaaaaaatctgtacatgcctcctaaaggttactggtattctctgactgataaggcaaaaattacacagacgataatctcaacaatgaaatacaaatatgtaatcaacaaagataaaaagaatgctcagaaaagcatgaagccacctttaaagaaaattttaaaggacctgatatttttaaaaagagaatgttcaacatgttaacagataacaataactgaagcaatttgtacatctataccaaattgatcactaggttttcatctctgtattttgagcactgacaataaaaacaaagctctctgaaatgtgaaaacaaaatgttctcatttttcagagacactcctaaaaaaggcatgtttgaaattatctgaaataacaaatatactttaaacaactggcaaatattagcaaatttaagacatattttataaacaaattttaaagcatttttaggccaggtgcaatggctcacatctgtaatcccaacactctgggactgcttgaacccaggaattcgagaccagactgggcaacatagtgagacccgccacctctacaaaaaaaaattttttttttaattagccaggtgtggtggcatgcacccatgggtcccagctactcgggaggctaaggtggcaagatcgctcaagcccaggtcgaggctgcagagagctgtgagcatgccactggactccagcctgggtgacacaaactgtctcaaaaaaataaaatattttttaaacatacacgattatatgtaatacaaattaaagggattttaaggaagctggctggtctcatttagactggggcttggccttttcaactatgaagagaggtgtacacaagaagaaagagattccctaccttgccgcccagtaacacccacatgtgaccactccctgcttccacacgactctgcaaagcagaatcatttaaaaaagacaattctatgacataaaatcctccaactgcttcccactggtcttaggataaagggcaaaataatcaacctatatgggacctcccaagctctgtaaaataaaactctccacctacctcccagccgcgttctcttccttcagccttgttcacactagttccttcaaagcactctgcacctttcccacttggggcactacacaggtaattctctctgctgacctctcactccaccaccatccctccaacctcggtgccaccatcacaacctcagggaagccttctgatccctcccatccaggccggatgtcagtgcactgcactttcttattggattatgtgattgtccacctgtctcaatggacaccaaactccaagagatggcaatctatccctcttgttcaccatactgggatctactcatcaactatttagcgcatgctacctaccagatattgttctaaggcttaggttcatactgaggagcaaaatataaatcttgatctcataagagtttacattcaagtatgagaagacgggccatacataaattagtaagtaaattatatggtatgttatagtgtcataaatactatgaaaaaagtacagcaagaaggggagacaaggagagtgcagggcaggatacaccataatatatgtgactgttgtagcagactatccaaagaagcatgcagctgagagccagccacttccagaggccagtctctatggctttacatagaacaatgcactttcctattcctgctggatgacgggccttacagaaaaatcctgttgcctttcatctttgcatccctagtgttcaactggtcagaacacctgccacaggaagaaaatgaacccttttcttaccgtaatctcagtggccctcctttatgccaggccctttagcaatacttaacagaaaataaaaaatggaaaaacatccactaaagtttaaaagatacattttcaatattgcaattgtttcattttgggttaacatgatgtttttattttaaagcaaaataaaggtaagaaattctatggctatctaaaagggggcatttattttattttatttcattttttttcagacagagcctcactctgtcgcccaggctggagtgcagtggtgtgatctcagatcactgcaacctctgcctcccgggtttaagcaattctcccgcctcagcctcccaagtagctgggattacgagcacgcaccaccacgcctggctaatttttgtatttttagtacagacaggttttcaccatgttggccaggctggtctcgaactcctaacctcaggtgatccacccgcctcggcctcccagagtgctgggattacaggcgtgaatcaaagtgcctggccgaaagagggcacgtttttaaagactgagaaacagtataatttaaaggtcatgtggctaaattactctatctgaaaatactttatgcgctaaatgtagctatgaaaagtcagttaaaaacttgtaaatataacttttatactctataagaaactttctaatgtatgctttttgagtaaagattttcctatttgtttacagaaatgtgcaagtatacaatcagcaaacaatttctctggaacacaggtgggagatgtctttgagcattcttatctctttacttgaattactttcactaaacatctacagtttaccagtccctgggctgggcagaggtgacaagcataaaaagagaatctcactcacaaggagcttacattaattatgtgctaagtaacacaaaggtacacttagttgctacagaaacagagaagcataatctcagaagttaatgcaaagcagtctggaggactcctaaaatatctttttaaggatggtttaaggagctaagtaaatattttaaaaatttttttaaaggaggtggacattcaatttcagtcaaagaatctaccaacagcaatggctacaacgtttgcaacaccaaggtaggagagggaggcgtggtcctgattaaaaggtggggcagggcaagaaggaagacacagaagtggaagcacacacagggcgaggcctagggcagtcctgatgagtttctgaaaagaggccagccatcaggctatgccacactctggctacagtgcgactaaaatgatttgtgtaaataaaagagcattttattgggcaaatttatgcacatcagacttcataaagaacactttcagcaaagatcaagtctcatctctatgattatcatactccccctaaaaaactaagcagtacgctttcaaatttgtgttaaacatggccgggcgcagtggctcacgcctgtaatcccagcactctgggaggccaaggcagatgggtcacttgaggtcagaagttcaagaccagcctggccaacacagtgaaacccaatttgtactaaagtacaaaaattagccgggcgtggtggcacgcacctgtatgtagtcccagctactcaggaggctgaggcaggggaatcgcttaaaccctggaggcagaggttgcagtgagccgtgatcgtgccagtgcgctccagcctgggcaacagaacgagactcggtctcaaaaaaaaaaaaaaaaattgtgttaaacatgaaatactttcaatattgcaatgtactccatggtctaggtctcctaaccagggcaatggggttgatgggaaagaagatgtaaaaccagtagcatcactgaactgcaaatcctttatggttgaaataggagccatgacagcttcaccagaaaaactatgagaagacagagtttataaaggcattgaagggacaaaaggtattaaggtatggggtggcgggggggcagtgagaaagagaagggaaggaaacacagctgagttaataattttccttgttcctaaggaaggcatttacacacaggaaaaacaaagcattagaacgttaggggaaaaaactttcaagttggaatttatctcccttcttttgagaacctagcagttttctaccttacaattccatgttctaaaaaaggaattcattttccaatcaaaataactctagaagtagagtagttacaaagatatcaaccagcataagagcaaaaagtttaaactgaactaaactcagacctgatgaggttaactctctgagtgcctcatttacttcgtactctaaaataagcttttacagaaaaaggagaactcttcacatcaataaagttctacaaaagagcataagcaaggaaacccttacagcagtgtctgtttttaacaaggtattttccaaaaacatgacttcagtgttcatgtcttctccccattggaaaaaggttgttttgagaattttgtagaagaaattacaagaatatactccaagatttttgtgcaatttatcaatctgaaaagaatatccctaaatctgacagaatctataagagtactgtatgcatgataaaagcatatttaaaacttgtacctttggccaggtacgccgtggctcacgcctgcaatcccagcactttgggaggccgaggcgggcgaatcacctgcggtcaggagttcaagaccagcctggccaacatggtgaaatcccaactctactaaaaatacaaaaaaaaaaaaaattagccaggtgtggtggagggcacctgtaatcccagctactcgggaggctgaggcaggagaatcacctgaacccgagaggcggaggatgcagtgagccaagaacgcaccattgcactccagcttgggcgacaagagtgaaagtccgcctcaggaaagaaaaaaaaaaaaaaacttgtacctttaacactaggataaaaacaaatgaaatcgattgatggtaacacatctatacagcttttttacaactttgagaggccctaacatagacaacacgttactaagattagaagacctagattataatcctagctatcactattttgacggaaaatatgaattttaacatgacaatgaaataacagtgaaaggagtttgtcagccactccttggctggtaacatctaccatagcctatcactacaaaaacttgcaaatctatgtagagtagctgcagctacctgaaggcactgttcattgtaaacaccattaacaatttgatgtcccaatttgcatgttttgggggtggggggagacaaggtctcactgttgtccaggatggagtgcagtggcaggatcatggctcactgcagcctcaacctcccaagctcaagcgatcttcccacttcagcttctccaacagctggactacaggtgtgagccaccatgcctggctaattttttgattttttggtagagatgaggtctctctatgttgcccaggctggtgaactcctgggctcctaaactcacctaggcctcccaaagtgctgggattacaggaatgagccacctcacccagcctgcacgtattttagaactacattttaagataatgtgaagactgcttcataaaaacaccttaaatatatacttgtcaaaacttgtgcttacttatggaaattgcattaaattcaataaattctttaaatctcacttttaaaaatggcaatcttcccgaacattaaaccaaattacatttctccctgaatttgctgccacttaatttcagctactcttctacagaatagtacccatgttatctttttttctgtctggttcctactcaaaaagagtggaactgctttctccaaatatgcattctgtgctcagaagctgttttctctgcccagatacatgtgtaaacaagccaaaaaaaacaaaacaaaaaaacaaaaacaaaaacaaaactttctgctaatagattgacagctacaaggtagaatattttaaaaattcagtaagctgggcgcagtggctcactcctgtaatcccaacactttgagaggccaaggcaggtggatcacttgaggccaggagttcgagaccagcctgggcaacatgctgaaaccccgtctctactaaaaatacaaaaattagccaggtgtggtggcatgtgcctgtaaatcccagctactcggggggctgaggcaggagaataacttgaagacctaggaggtggaggttgtagtgagttgagatcgtgtcactgcactccatcctgggtgacagaacaagactccaactcggggggggaagaaaaaaatcagtaatagtgaaaatagcaaaaccagacaacatttccatgtttgtgttacaacagtcctaagaaaatgagattatcatcatccccctgttacaattgagaaaatgtaggcaacacgagggtaacttctaatgaataagccatgcctttgtttcatataaataagtcaactcaactcacattaacttttcaaaataccggataaaatttatttctaaccaatgcaagtttcaaagataagtacacaaattaaatttatgattaaataataagcttgttaatctgatgcctttcggaacgcatttcacttagcaaacctcaattaagctatttcttatatggtttgattacaaaactgcctttcagcatattaaatacaaggagaaaaaactgaaaagccacaacgatttcaacttctgtaaattaccctgactgtaatgaggggcgccaggcaggttggggaagtatggaaattgcacactgcacacaccacctgaccaccaagaaaaaagaggacaccactcttccccactgtggtcttcacaaactacaactcagcacctatttcaagtgcatttaaatattcaaacaactgaaactaagagaaaaaaactttcgaaagggaaaataacttgtctgtccccttcaatgttcaccttggagttgctctcatctctagaaaaaggcctcacgcatactgtttatacttacaaactccactgccctgtcaaggaaaaccttcctgttttctcagttatccaaaacttcaaacttccaatttactattaagacaagttattgggcatccacttagagaatctcaaacgaaagccagataggaggtagttttctacagctaggtttctcaagtttcatctcagccaagttttaagaacgttttacgtaaaaataaggggaaaagcaaaattacattcgcatgaagtttcgacgcacaacggcactgaaacggaaagactcttcacgttcccaagcgcaccctgagaggcaggtgcagcagctttccgatggcttctctgccgcccatgtatcccagccccaagaccaacacaggcaatcttcacatctgactttatttttttaactccttcagatccacctctgctcaagtctatcaacaggaaaacaggagcgttccaaacacacaccgagcaacaggatcccaacttcctggttctaaaggaatgcgatgccctgatgacccgtcccgccccgcacccgcacggccgcctatccgggctccggcgggaccgaggagcgagtggcaaggctggcgccgcactgcgggtgccggcgcccgcccggcctgggggcgctcgcggcccgcgaccccggccccgcccaggccctgcccgacccccgtcctcgccggccttcgcccaaccccggcctcccgaccctgaccccggcccggtcttccgggcacccagctccgtcgactcccgcctcgcctcaacgggtcctcctaagccccggccccggccttcccctgccccggcctcggccatcctcagccccagttttcccctgccccggccccggtcctcctcagccccggctttttcctggccctgaccccggtcctcctcagccctggcccttcccgtgccctagccccggtcctcctcaacccggccccggccttcccctgccccggccccggccccggcccaggcccggccctgcccgccgcggccgcgtcctccgggaagatggcggcgcagtgacaggcggcgcggcgcgggtccgagctgggccgggagggacggcccgccgcggcccagggtgcctcacctgtcagcgccgccgccccgcccgaccggccgcccgcgggctcctcgcctcaaccccggggcccggcggccgcgccacacgcggggacggcgaggagagagacggcagggagaggcggcgcggccgggccgggccgggccggaggtaggggagagggcgggcgcgagctggcggcggcggcggcggcggattcttcccctttcgggcccgaaaatgtctcaaccccgggactccagatccccaacgctccttcccgttcgcatgagaacacacagctc

SEQ ID NO: 274 - DNA, 29360 bp, Homo sapiens
ggaagtcccacctgcgcccgacggcggaagttccgggagtgccaagtacccgcgtgcatacggctgccggcatggcacattacaacttcaagaaaattacggtggtgccgtccgccaaggtaggcggccccgggagggccactgcaactttcgcgttctcctcagctgggtccccggggagggtccgggcctgtagccgtgggagagcggtcgccttccgctcgcccatcccccgctcctgggcctgaccgtctggccgcgtactcgggatcatttcccctcccccagcagaatccggggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggttcgttgttctcgtgatttaacgtttcataatttttaagtcattctctttcactgttagatttgggaatacctgttccttttcagaccatagtaggcccagactaaatttttacagcgttggttggtgtggcaagaatgagtcaacaagtgttgagtattaggactttttttttttttttttttttttgagacatagtttttcgctcttgtttcccaggctggagcgcagtctcggctcactgcaacctccacctcccgcgttcaagcgattctcctgcttcagcctcccgagtaacagggattacagtcgtgcaccaccacacccagctaattttcgtatttttagtagagacggggtttcaccacgttggccaagctggcctcgaactcctgatcccgggtgatcctcccgccccggcctcccaaagtgctggaattacaggcgtgagccactgcgcccggccctagtattaggacttttaagaagtcacgtttttatgtagtgaacattcgatttgggtcgcaattacacagacattgacgggcaactggagcctcccagggactcctgcacgagagggagttactgaagtccctgcagagtgactgttttcccctcgtcagtgcctccttttcttcaggtctcaaggacgggatgagcttgccttggaaagctttgtgggagtctcgtattttaccttcatagcaaaagttgtttccccacttctctccaccatttcttatttcttcctgacagttgttctggcacatctcttgatcgattgtagtattttctttctttctttttgagatggagtctcgctctgttggccaggttggagcgcagtggtgtgatcctgactgcagccaccgcctcccaggttcaagtgattttcctgcctcagcctcccgagtagctgggactacaggcatgcgccaccaggcctggctaatttttgtattttcagtagaagtggagtttcaccatgttggccagactggtcttgaactcctaatctcaagtgattcacttgcctcagcctcccaaagtgttaggattacaggcatgagctactgtgcccagccagattgtagtattttcgagtgcaggagtcatgtcttatttgtatttttggtcaaccatctctcaggtttgttgaaggaatttgctctttggattatatgaactttgttcatgttattgacttatgtggagaactttagaatatattatacaccatccgtcttctgttctgtggagtgagatttatatttttagagaacagatgacttatctaaaaactgggtgatggtaattgtttggtgattggaagtaaaaaaaaaaaatcacatcgggaaagtgtggtattcagttcattctagaagatgttgagtgagtgcctgtcctgtgcatcgggtactgtgttacaaaaatgcattagataaaatacctgcctctttggaagtcattttcaagagaggtaagtcgaggccgggtgcggtggctctcgcctgtaatcccagcactttgggaggctgaggcgggcaaatcacgaggtcaggagatcgagaccatcctggctaacacggtgaaaccccgtctctactaaaaatacagaaaaattagccaggcgtggtggcgggcgcctgtagtcccagctgctggggaggctgaggcaggagaatggtgtgaactgaacccaggaggcagagcttgcagtgaaccgagatcgcgccactgcactccagcctgggcaacagagcaagactccatctcaaaaaaaaaaaaaaaaaaaagtggggtaagtcatatctcgtatgaccatactagaaataaaacattgttatcatggaggacacacatggattgggagaggagaagagtgtggttagctgtggtaagttggagagtcagggggaaccttatgaagtaggtaacctttgacttggtcccccttcaggatgtgcgaacggcattaggtgcagaagaacgtagagaagatcttgtgtgggcccagaggggagaccgtgtgtgcccctcatagtacttggcagactgttgtgaccacccgtttacttgtctcacttgtaggcccagaggggagacagtgtgtgccccttatagtacttggcagactgttgtgaccacccatttacttgtctcacttgtaggcccagaggggagactgggcgtgcccctcatagtacaatacttggcagactgtgttgtgcccacctgtttacttctgtcactggaccctgaattccgtgaaggaagggacagtatcttgttcattatcctcagcacccaagtatccctaacaacctttgtatgaaataatattgagttaatcaaattgttgaattaatcaaagtgttcaagaaaaaaggtcaagtaatattgtgtggctagatacattggatttaggaatcctggggatcggatccttattaaagagaagtgctgactctttgcactgggtaactcatgcaaaaatccttcatctcctcaaatagttcccttccatctctttggaaattataaacagtggattttagttttacctgttattttatgtactttcaaagtcaagggtatgcataaacaaatgggaggattgtttctttttctcaactattctaatttatggtttgaattctctgattatttaagtttcaaaggttcttaggtgtttggaaattaagatagcatcaagaaagtatggtgtaaaatttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggccggtgtaaaatttatcttagccatgtgtttcaagatgaacaaggttgtacatgaaacgtttagtaaatttttgtaatttaaaatatgtagtactgtaagatattagtgttttaagaaggtttcagggccgggcgtggtggctcacacctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctgtagtcccagctactctggaggctgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgcagtttgcctgtttctttttttctcttttttttggagactgagtctcactctgttgcccaggctggagtgcagtggcgtgatctcagcccgctgaaatctctacctcctggattcaagcaattcttgtgcttcagcctcccgcgtagctgggattacaggtgcataaccacgcctaatttttgtatttttagtagaaatggggtttcaccatgttggccaggctggtcttgaactcctgacctcaaatgatctacctgcctcagcctcccaaagtgctgggattacaggcgtgagccaccacgcctggcctgcctgtttctttagctgtagaaaagcaagagcagaaactgcctggcaaactaacaaagccttatgacaccatgtgtggggtaatgtggttgcaaggttaattgaggttgtgaagggcgtggggatcagcagtatagtctcaaagcctaaatctgccgttgccccagaatagtccctgaaggcaggtgtaggcagagagaaatgtttggcttctgtgacagtacttcatatttaaacaagttataatggctttttttttttaagccagagtatcacaatctcagctccctgcaacctccacctcccaggttcaagcgattctcctgcctcagcctcccaagtagctgggattacaggtgcccgccaccacgcccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgggaaaggtcaggtactagagagtacctgggggtgaagaaagtgatttaagaatgagatttttgtttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacctcaggtgatccgcctgccttggcctcccaaagtgctgggattacagacataagccacagtgcctggccaagaatgagattattcttaactgatttgatattaggaaatatttgattttagccaacaacatactttgatctacttagtatcagatttttgtggttctttttaagaagttttgtctttttcatcctcagtgttatagccatcagaggtaggagagttcaaatgtattaacattctattactctttttaaagccaggactagttatctgagaacagcttcagagtggagggttagatattaagttgtcattcactgaatgcttattgtctgtcaggtactgttctgagtcctaggaatccagaagtggtaaaggttcctgctctcattctggtggagaaaagatagtaaatagcatgtcagatgaatgcagtgaagccatggaagggagtagggagtatctgtgcggggagagggtgtcaggcctgtagtcaaagaagcagcaggtgcaggagacccaggaggtggggcaggctagggaggtgaacactgggacatgggattggaggtggtagtcaagggtcgagtttatatgcactggtgagatatctcaggagatgctggcctggtgatttaaaatgcattagtaaaatgtagacgacatttaaatctatctgagatcaccttggaagggaatgtaggaagaagggtgctgtggggagcatgaatgtttggggtagagctgtgagcactagccagcacaggacttagaggggtcagactctccacctagaagctgtgaggaaaataccgcaggcaggatgcatggccagcccgcagcgtttcaagaggtctgtgagataaaaactgagaattggtcattgggaggtccttggtgagcttgtaggctgtttagatggagtggtggacacagaattctggagagagtgggttcaagagagggaggagaggagagacacagtgtgtcttgggagcaaagagagggaattggaaggattttggggctatgggaatttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaataatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaacacttgtatttaataggactttctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccataggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcctcctgcctcagcctcctgaagtgctgggattacaggcatgaatcactccaccctaccttaagatcacttttgctttgaaatagatttgtgagttttattttgtctacaggttgctgtgacatggtgaccagcaaagctctgcagggtccttgctgatttttcaaatgcttgtcagctctgaacctgccctgagctctgagccagtgctctgtggccgatttggtggccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctcctattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcaggtgagagtcttgtctttatttttattcatttatttattttgagttggagtttcactcttgttgcccaggctggagtgcagtggcatgatctcagtccactgcaaccttcacctcccaggttcaagtgattctcctgcctcagcctttcgagtagcagggattacaggtgcacaccaccacgaccggccaatttttgtgtttttttagtagagagggggtttcaccatgttggccaggctggtcttgaactcctgacttcaggtgatctgcccgccttggcctcccaaagtgctaggattacaggtgtgagtcacactgcacctggcaagagtcttgtctttaaacagaacaaatatcttggtttatcaagaacttgaaatttctccatcatcataaagaaaactcatctgagctcttgggatgcataagaacaggtcgcatgtctctgatataattcaggggaggcagccagctgccagtgtggatttctgcattttcttaacataaaatgaaattatctttgtgtcatttctaactctgttatcagaaatggcatatatacagtttaaaagcgtgaagcaggctgggcacagtgattcacgcctgtaatcccaacactttgggaggccaaggcaggcagctaacctgaggtcagaagttcgagattggcctggccaacatggcgaaaccccatctctactaaaaatacaaaaattagctggacgtggtggtgggtgcctgtaatcccagctacttggaaggctgaggctggagaatcgcttgaacccagaagacaggggttgcagtgagccgagattgtgccattgcactccagcctgggcgacaggagcgaaactctgtctcaaaaaaaataaataaatacaaagcaagaagcaatgtttccacactctaattttgtaaattgtgaagaaagtaattcctaagacatgggagggttctcagttatcccagtttttgtgttttatgatgtcgctggtaaaaagaggagtcatttctctcaacatcatggctagcatttctttgagctctacagggttcctcctcccttttttgatgtttaaatagtatgtacttttctgtcactggtttattttgtggtattcagtttgggagacctacttttttttttttttttttttttttgagatggagtctctgtcacccaggctggagtgcagtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctggcccagcaatgtcagcatcaccttcttaatttcttccttaatttcctcattgatccattggtcattctgggacatgtttataattctcatgggtggtttttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcgtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagctattcctacttgcttttagtttccatctgcgtagaatatctttttgcatctcttcattttcagtctatgtgtgtcttaatgtctttacaggttaagtgaatttcttggatactttttcatgttttcatgatagtgattattgtcttcgcttccagatgtaggactttcttaagtatatcttgtaaggctggtctagtagtgacgaattctctgtttttgcttttctcggaaagaatttatttctcccttatttctgaaggatagctttgctggatgtaatatagttggctggcagtcttcttttttttcttcaacactttgaatatatatcatcccattgtctcctggcgtgcaaggtttctgcaaagaaatctgctgttagtctaatggggattttcttatatgtgacttcaagcttttctctagctgtttttagaatttcctttatatttgacttttgacagtttgactataatgtgccttggggaagacctttctgggctgactctatttgggaattcttgaacttcctggttttagatgtctatacctctccccagtcttggaaagttttcagctatctcattaaataggttactaagccttttcccttctcttctccttcttgaactcccataatgccagcatgtattcacttaatgttgtcccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctcattgagtttccttcaaaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacctccatgaaatgttggcaataactgggtggctcagtggcctcagctctggaagtttgtgccagcggtggtgtatgtttttaaggtccttggtgtcaggggcttttggggtcctgctattcttgtttttcccgcaatgggggacttatctgaggggatctttcttggtgtcaggtctgacatggtctgcaagcagctgccacagtgctgggtttcagctacaggtactcagggtagctgtgggactggggtcctagccttagggtcttgtgtgcctatcatggcctggccttggggtgcaggtttactctctgtggtggatctctgatcctgaagcacccctagcagcttaagcccacagggcaaggctgtggctgtggctccacccgtggggtcagggcacagtcctggcctgactccagggaagacgcactctggaggtttgagcctgggaagcagggtagagctgtacttcagaaacctgagccagtagggagggcttagtgtcagctcaaggggaactctggaccctgggatggtggggcccagcagtatcccagactctctgatgctaggtgaggtggcagcaaggaccccagaatggactagtccagctgtcatttgggccctagaggacagggaggaggacagcagtgactccatttcctggaaagagtggtgactctgcagctcagaatatagggttagtccagctccagggagcaggtgctggagctgtttgcgtggtggggcaggtgcctcggctcagcccctgccctgtttccctggggtgtggagtacaatgtcagctcctccccatggtatgtggctggtcagcctgggcctgagggttgtgactcttctgggcgccccaggcaccgttgccctgggatacaaggtacctcttcagcatagacgctgggatatgtgaccattctgggcatttcccaggaagcagggcactgcttcagctcaggcagcagggagacaacgttccctgagaggccacggtgctatttaccaggaggcagggtaccgttgggtgctagagcaagggctagtagaggggctccacctccaccaagccctgctgggaaggggtagcagctgctcacagctggcttggggatgttgggccaccaggtttgggtagtttggaggcagtttagcctcagggatgaaggggagctgtggccacttcccctgagcaagacatactccagccgcagttccagtcccaagatgatggagtatagccgccccatgggcccaacagacagggcccagtgtcagctccttctgtgtgggagcacagctgtgaggatgccagggggctccggtggtgagggctgtgggtgtccagagtggtggcagggctgctgccatcctcttgcttaccccctcaccgtagggagaacctcctcctgggtcccgttgcatcccagctgtagggtgggttgctggcggcccagtgtgttttttttggtttgtttgtttgtttgtttgttttaagacggagtctcgctctgtcccccaggctggagtgcagtggcgtgatctctgctcaatgcaagctccacctcccaggttcacaccattctcctgcctcagcctcccgagtagctgggactacaggcggccgccaccacgcctggctaattttttatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagctgttgtctctggccttttaatatttcggtagcaagtacagtgaaaattatttttatggaacctgttcgaagtagaagggagaaaagtctgaaaagcagaacagcttttgcaggaggcagtccgctgctggatttcacatgctgtcctaattactttgtatttcatgttgtttttatctcaaataaaaggacatttctggccaggcgcagtggctcacgcctgtaatcccagcactttgggaggctgaggcgggtagatcacccaaggtcgggagttcgagaccagcctggccaacgtggtgaaactccgtctctcctaaaaatacaaaattagccgggcgtggtagcgcatgcttgtaatcccagctactcgggaggctgaggcaggagaatcgtttgaacctgggaggcggaggttgctgtgagctgagatcatgccactgcactacagcctgggcagcaagagcgagataccatctcaaaaaaaaagatggcactcctgatgccatggtcgcactcaggatttaaaaagatggcactcctgatgccatggtcgcactcaggaatttgttgctcggttagagtcctgaggggcaacattgcctccggttcgtgaagggcagttggagggcaccgtctgtgcagagggtcactgtggtgggagagaggcccaggcactggagatgcaccttccctcagggccgcttccacctgggcctcagagaatgtggccccctacgtgttagttaccttgagggaaaaggctcagtggctctgatctgtggctcctcctggaacctgtagctggaggctgctggaggatgcgtttgtgactgtgccttcttttttacgttattaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattagtttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttcattgttttgtccattgtgaatgggcacacatcgttacgctgtgtcttcatgttttactgcaaatgtgtctgcacttcaccatgtggtgttgacaacgttcctgtcccacagacgccttcctggtgtgtgctgcactgacgctggaggctgtgtccttccctctgtctttccttgtgtcctcggcgtggtcgggcactgactgtcagtcttgtgtaaagatgattttattgttgtgtgtttatgtaatgctgggtgcggttgagcatgtttgtctgcttattggccttttcaaagttctttaggctgtttatctttttctcgctgatttgttacttttgtattacaaaggttggattcttgtcagatacattgcaaatttttttctctttttgtcacttgcctttttaacttcaaatgtgctgtacatttttgaactattaacatatattaatttttttttctgggtgttcaggtttgcattgtacatagaaaggcttaccattcattccaaagtcattttaaaagtatcttttcttgctgggtgcagtggctcacgtctgtaatcccagcactctgggaggccgaggcgggtggatcacctgaggtcaagagtctgagaccagcctggcaatcatggtgaaaccccatctctgctaaaactacgaaaattagtcgggcgcgcacctataattctacctattcaggaggctgaggcgggagaatcgtttgaacctgggaggtggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcactccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctggatctgaaaggcaaaatgaagctgatgataatttctctttctattgcaggaacgagatcttgagctggaaatgggagatgattatattttggatcttcagagtaagggccagagtgtgatcattattataaaatgccaattggacgtgaagtatttcagaaaatgggggaaagactttaataagtaataaaagtgtttcagcctatttgtcaacttttaatttcttgaagattaaaagttgcatcctgagggccaggtgcagtggctcacgcctgtaatcacagcactttggatcccttatgcccaggagtttgagaccaacctgggcaacatggcagaaccccgtctctacaaaaaatacaaagattagccgggtgtggtggcatgtgcctgtagttccagtgacacgggaggctgaggtgggaggatcacttgaccctaggaggacaaggctgcagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggctctgctatgctggcctgcccccttcccgccgcctccacccacccaccccggacactctggtggagatgctgggccccttcgttatcctgcacccctccatcctgactctgcctcctgcacctcttccctgtcccgacactggtggagatgctgggccccttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctccgccaggccctggatgggctctgctgtgctgggcccttcattctcctgcatccctccatcctgactgtgcctcctgcacctcttccccccaccccgagactctggtggagatgctgggccccttcattctcctgcatccctccatcctgactgtgccccctgcaccaccttccccaccctgtatctccgccaggcccttaatggactctgctgtgctggaccctcttccttgggggctccgctgtgtcacatctttttcctgcctcaatcccctccctacttgctttttcttagcatataaaagtccacaagttttactcatctttttaaaaaacgaaaacatccttagaccgtgtcctccattagttgctatcctgccttcttctctcagctgagctgtctgaaacatgctaacatgcttatacaatacttgctgtcctgccttctgctctcagctgagctctctggaacatgctttttatacaatacttgctgtcctgccttcttctctcagctgagctctctggaacattctttttatacaatacttgccatctgcatgtcccatgttgccactccttggttcccacaggccctccgtcattgagttcacattttcagtctcgtggtctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctcttgggcgcaagaagccttgagacttccctcctccgcacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcgggttcaagcaattctcctgcctcagcctcccgagtagctgggattacaggcacctgccactacgcctggctaacttttgtatttttagtggagatggggtttcaccatgttggccaggctggtctcaaactccttacctcaagtgatctgcctgccttggcctcccaaagtgctgagattacaggcgtgagccaccacgcccggctggttttcttgttctttaatttctgcattaaatctggactctttaggccgggcgcagtggctcacgcctgtaatctcagcactttgggaggctgaggtgggtggatcacgaggtcaggagattgagaccatcctggctaaaacagtgaaaccccgtctctactaaaaatgcagaaaaattagctgggcgtggtggcgggcgcctgtagtcccagctactcgggaggctggggcaggaaaatggtgtgaacccgggaggcagagcttgcagtgagccgagattgtgccagtgcactccagcctgggcaacagagcaagactccatctcaaaaaataaaaaatttaaaaaaaaatctggactctttagcaatttacagaaacctgacgcagtctacaaaaggcaatttattggctctgtggcagggtgggactgggggaagaaagcccacatgcagggcagttaacatgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccccgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagccgtgggaacgtgggaaattacagcaaaaagaaatgagagcttccagtttttctcttttgagattcgctggccctgggactgacttgaagtgatgggttgaggattccctgaccctgggtctgggttgaagtggtggattgaggctgcactccagcctgggcaacagagcaagactgtgtctcaaaaaaaaaaaagctccacagccagcacgagacagcaccatgacgtgcccagggtgtggctgcagaccctgtcctctagatgtgcagtctgcagtttccgtctgatggtttctgtctgatggttgtccctttgtgttcatatcagtaacccccaaaatggggcagtgagggagagagcattgtttatatctgaaatataaattgtgatgctatactataataatcacttttaaatgagagttctaagtttctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagtggacctggggtcctgagcgctgagcctgggagtggacctggggtcctgagcgctgagcctgggagtggggctggggtcctgagcgctgagcctgggagtggggctggggtcctgagctctgagcctgggagcggggctggggtcctgagcgctgagcctgggagcggggctggggtcctgagcgctgagcctgggagcggggctggggtcctgagcgctgagcctgggagtggacctggggtcctgagcgctgagcactgagcctgggagtggacctggggtcctgagcgctgagcactgagcctgggagtggacctggggtcctgagcgctgagcattgcttcccctgctttgcaggcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaaggtcagtctctgtgttgtgtaatgtaataaaatgacagtctctgttgtttattgcacagggttcagggcaaacaccagcagttgccatttgcaggaactatggcaggggttgtgtgtactgcatgccctcgttttgtggcatcctttagaggagagcacgggtcagggtgcaggtggatgcccctgacagctgccctggatggacccctccttggcactttgcttttgcggagggtggccagagcatggtctgacagcactagcagtctgggcttagaccctgctgtctgaagagggccaggaagtggccacagctgagcaccaggaggcctcaagtccagcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccattgccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaacaggggtaactgtgctgggcttaagagaaaagagatgtaacaggggtaactgtgctgggcttaagagaaaagagatgtaacagggataactgtgctgggcttaagagaaaagagatgtaacagggtctcttcgctgagcagacctgagccattaaacagattgttacccagtagttgaaattcagaatggaaaattggttttaagtaatgaacatactttatttttttctcctccttttagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaaca

SEQ ID NO: 275 - DNA, 6953 bp, Homo sapiens
atgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctcagaaaatgaacactttctttggtaattgataatttccaaaacctcgattttagctaagtaaatttttgtggactcaagtctgaatgataaaccggctttggtttcttggttccagtaaacctgtctgtcttcatttaaagaactaaccgtgtcacacacacatcctcaacagaaaaccccgtagaaaccggctagcgttgtcaggagaacatccatcctctcttaaacgtgttcttgagtggatgaaggtaacacatgctcacaggatcctggacattctttctacacttgaatttctttcttttttttttttttgagatggagtctcgctctgtcgccaggctggagtgcagtggcacaatcccggctcactgcaacctctgactcccaagtagctgggattacaggcgtgtgccactacgcccagctaatttttgtacttttaatagagacggggtttcaccatgttggccaggatggtcttgatttcttgaccttgtgatccgcccgcctcggcctcccaaagtgatgggattacaggcgtgagccaccacgcccggcttgaatttcctcttcggtgtgtggtcgacagattcctgcacagtctcaaccctgcctgggacacatagggactcacactgccccatccacagctacattcacagccccattcacagccccattcacagctcattcacagccccatccacagccccatccttcatcctcatggtgcttcatgaggtcaatggtgtagatccagcctggactttgttcaccgtctgcccgctgccaacctggactcccgtggacacagctgagactggatgctgtgtgtacctgctccccaggaattcccagctctgcttgcagacgcctctgggctgccctcctcactccgatggcatccttttcttccagttctgctgggttgtataatgggtggctactacaggagtcggtaaaataccctggaaaaaatgcatgtgggaacatccctctttattcctgaaaagtgaatatattaaatacaaatgcagatgcttcatgtaaaaccatcatccgtcatcagcagaagacagcctggcggggggagtgggtttgtcatgggctctcagagcagcactcgcctccagcctccacggctgtgggcttggtgagggtcttccacatgaccacctggcggggctggccctgaccgctcctgcggcccttcctgcagatgtgcacacacatgtcccgtggcactatcccagtatgtcttaggagagggactggttcctactcagttttgtacccacagaggacctgagatgccatggggtggcgggaggaggtggtggggctgtgggctgggtggctgcaccagctgggctgaggaagctgggctgcactttgagggtggtgatcagtgagcatggtttcacaggaagactgctggaatacctttgaccaagtttccttactgagaggttctacttaatttacccaagtaacagcaatagcgctatgacgggaggtcacactctcctcagtaaatctctgttccctctcgttcctcagaccctcagtgcttccttcggtcactctgcaaggagtttggctgaagttgaatccactcttgcaagtacaagagctggtactcccacctgcccctatgtatcctggaggcggctaacacatgataggaaatcttagctccaggggctttatttgcaaactgttgactatgtactacagttgaccctcttaactttgcagctcctgaatttttctgaaacaaactttgcattcagctccatcaaggagcccgtgagtacaacttgaccagcaagtatggtggtgggtttgggaatgggcaggatgtacccactgcggctccgaggaagaactaagggaggagaaaacctcggccacagctggccgtgcttagccattcgctttaatggctcaggcaaggtctggttttgaaaatttgaggacagcctaggccaaaacactttaaatgaccacaattgacgtaaatgctgttcccctctaaaaaattttttggccgggcccggtggctcacgcctataatcccagcactttggaaggccaagacaggcatatcacgaggtcaggagatcgagaccatcctggctaacacggtgaaaccccgtctctactaaaaatacaaaacgttacccgggtgtggtggcgggcgcctgtagtcccagctacttgggaggctgaggcaggacaatggcgtgaacccaggaggcggggcttgcagtgagccgagatggcgccactgcactccagcctgggtgactgagccagactccatctccaaaaaaaaaaaaaaattttaagttgtaattttaagaagtacaagataattaaaactctaagacctgtaagataatttttattattattacctagttaattttatgctaaatgctattttaatcccctaaatccttaggttgataaattcctctgcatttaagtaacttgccgttgcaaagaaacaacaaaacaaaaaaacccagaaactcatatagtttcttacttttttaaaaaagaaaacccagcctactgaagagctatcagcataattagcatctgcctaagctgccgattttctgcaggatgagctgccagctcaccacagtgcggcactgagcaccagagagttcctgtcccagattcctccggtcaagtcacatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtaagtgccatttgtgtgagtgcatgcctggagtctgtacgattgtccttcgtgctttttgtcctcagtctgtttctcgtagaaaagcctgtgattgtggcacctgggcagggcaaaggggactgctggatgcccaaacacaacgtttcagaatctcagcggattagaacactcgggaaactaaaaatagatctaccagatgacccagaaatcccactaccagggcaaatatccaaaataaaagagatcagtctatcagagagatatcgcagcattcctgggtgctgagcaccatttacgacagccaagatatgagatcaacctgtgtccgtggaggtttgaagggttgaaaacatgagggttagatacacagtggcataccattccaccacaaaagaagaatgaaatcgggccgggtgcggtggctcacgcctgtaatctcagcactttgggaggctgaagtgggcggatcacgaggtcagaagatcgagaccaccctggctaacatggtgaaaccccgtctctactaaaaatacaaaaaaattagctgggcgtggtggcaggtgcctgtagtccaagctactcgggaggctgaggcaggagaatggcatgaacccaggaggcagagctggcagtgacctgagattgcaccactgcactccagcctgggcaatggagcaagactctgtctcaaaaaaaaaaaaaaaaagaagaatgaaatcctgtcatttgtagcaacatggatggaactggaggccattgtgttaagtggaacaaacctggcacagaaaaacaagtatcacatgttctcactgctatgtgggctctaaagaagttgatctcatggaggcagaaaacacaatgctagacaccagaggctgcgaagggcagtggggagggatgacgagagggtggttaataagtataaacataccgcgatagagaaggaataatatcagctgttcaatagcacagtagggtgactgtagttaacaacagtgtattatatgtttcaatgtggctagaacagaggatttggaatgttcccaacacaaagatatgatgaatgtttgaggtgatggatatcccaaaatgccctatttgatcattatgcatgacatggtggtatcaaactatcacatgtaccccattaatatgcataattattatgtgtttataaaaaagacacaaaaatgaaaattaaaaaataataaaatggcttaagatggtcaaagaaaaccagagctggacaggagttaaagcaggaaagtctgactttactgagaaccatttcaataggggaaagagacctccatggagaaccagcctaactgcacacaacacccaaggagcaggctggggcctatggattaaaagttactaagagaaaacatcagtgggaagggggttctggctacaccgacctaacaagacctgctgaagacaggcctgcgtgatcagacgtcacctgggagggacggggttgaggaatttaatcagatgccaaggtcagggttctcgctaaaacaacctggtagaattcttgctgaaacaggatcttacgaggaagagcacggatgcctaggagaaggtgcaggagcctgacaagggcttgaccaagcaaagacgtcatccaggtgctgctccccgagccttctaaagacggcacagcaagcacacaggtgacccagtggtcgcctcctagccggaaaggcctagactctcttcttaggttgccgtcgggtgggaaaaatgggaaaaccctgggaactggacagagaaaatgggcgggggctacctttctcaatgttttcgttcagatggcaattcctcttggtgtcggcaccaataaccttatcattctcatccacaacaatcagcatttcctccaagcgctgcaactgacgcctgtcaacccagtcaagatttatgtcagacatagctgctggctgtgacccgacctgaaatagatgcacacaaatgcctctttatgtgaaagatattgccatctcgtttttgctatgtgttaccaaccacattaggatttagcatacaccttctctacaagtgacagcaattgtgttgaagcagcacagttctgagatatggaaggtgaatcatctgtttctaatgtggtgtctctctgaacgggaaatcttgggtacatacatactcctcatgttttccaggtttcctttagtgacgagttaaagaatccccgccccaccacacacacacacacacacacacacacacacacacacacacaaaacacaccgaggtaaactgtaggtaacactctttgtacaagtttttggggaaaagtgcagccctgtgcaaaaccactggacctggatcagacgtggagaaacacacagccttgtaggaaagctacgtcacccacagaagggctatggtcctcttcagagccaagcagattcttaggtgaagatcttctcacaaaatgttttcagggccaggagcggtggctcacgtctgtaatcccagtactttgggaggccgaggtgggaggatcacttgaggtcaagagtttgagaccagcctggccaacatggtggaaccctctctctactaaaaaatacaaaaattagccaggcctggtggcacatgcctgtattcccagctactcaggaggctgaggcaggagaatcacttgaacctgggaagcagaggttgcagtgagccgagatcgtgccattgctctccagcctgggcagacagagtgagactctgtctcaaaaaaaaaaaaaaaaaatgttttcagggtcatttatcttcatgtaaaaccttctcatcatccttttctactttttaaaaaaatgcattcacgtctgtccattatcattactgttaatattttcagcaatctgctcctcctctttgcaaaaggctgtttgacttaatgcatggacatgagatacaatagaaatgcagagaaaacaattactgaatatgtacaaatttagatcataaaagaaagaattcccacaaggtaaaacatatgcactaacctctcttggaagctggagactcctgggtatcagatgtggaactc

SEQ ID NO: 276 - DNA, 21565 bp, Homo sapiens
acatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtaagtgccatttgtgtgagtgcatgcctggagtctgtacgattgtccttcgtgctttttgtcctcagtctgtttctcgtagaaaagcctgtgattgtggcacctgggcagggcaaaggggactgctggatgcccaaacacaacgtttcagaatctcagcggattagaacactcgggaaactaaaaatagatctaccagatgacccagaaatcccactaccagggcaaatatccaaaataaaagagatcagtctatcagagagatatcgcagcattcctgggtgctgagcaccatttacgacagccaagatatgagatcaacctgtgtccgtggaggtttgaagggttgaaaacatgagggttagatacacagtggcataccattccaccacaaaagaagaatgaaatcgggccgggtgcggtggctcacgcctgtaatctcagcactttgggaggctgaagtgggcggatcacgaggtcagaagatcgagaccaccctggctaacatggtgaaaccccgtctctactaaaaatacaaaaaaattagctgggcgtggtggcaggtgcctgtagtccaagctactcgggaggctgaggcaggagaatggcatgaacccaggaggcagagctggcagtgacctgagattgcaccactgcactccagcctgggcaatggagcaagactctgtctcaaaaaaaaaaaaaaaaagaagaatgaaatcctgtcatttgtagcaacatggatggaactggaggccattgtgttaagtggaacaaacctggcacagaaaaacaagtatcacatgttctcactgctatgtgggctctaaagaagttgatctcatggaggcagaaaacacaatgctagacaccagaggctgcgaagggcagtggggagggatgacgagagggtggttaataagtataaacataccgcgatagagaaggaataatatcagctgttcaatagcacagtagggtgactgtagttaacaacagtgtattatatgtttcaatgtggctagaacagaggatttggaatgttcccaacacaaagatatgatgaatgtttgaggtgatggatatcccaaaatgccctatttgatcattatgcatgacatggtggtatcaaactatcacatgtaccccattaatatgcataattattatgtgtttataaaaaagacacaaaaatgaaaattaaaaaataataaaatggcttaagatggtcaaagaaaaccagagctggacaggagttaaagcaggaaagtctgactttactgagaaccatttcaataggggaaagagacctccatggagaaccagcctaactgcacacaacacccaaggagcaggctggggcctatggattaaaagttactaagagaaaacatcagtgggaagggggttctggctacaccgacctaacaagacctgctgaagacaggcctgcgtgatcagacgtcacctgggagggacggggttgaggaatttaatcagatgccaaggtcagggttctcgctaaaacaacctggtagaattcttgctgaaacaggatcttacgaggaagagcacggatgcctaggagaaggtgcaggagcctgacaagggcttgaccaagcaaagacgtcatccaggtgctgctccccgagccttctaaagacggcacagcaagcacacaggtgacccagtggtcgcctcctagccggaaaggcctagactctcttcttaggttgccgtcgggtgggaaaaatgggaaaaccctgggaactggacagagaaaatgggcgggggctacctttctcaatgttttcgttcagatggcaattcctcttggtgtcggcaccaataaccttatcattctcatccacaacaatcagcatttcctccaagcgctgcaactgacgcctgtcaacccagtcaagatttatgtcagacatagctgctggctgtgacccgacctgaaatagatgcacacaaatgcctctttatgtgaaagatattgccatctcgtttttgctatgtgttaccaaccacattaggatttagcatacaccttctctacaagtgacagcaattgtgttgaagcagcacagttctgagatatggaaggtgaatcatctgtttctaatgtggtgtctctctgaacgggaaatcttgggtacatacatactcctcatgttttccaggtttcctttagtgacgagttaaagaatccccgccccaccacacacacacacacacacacacacacacacacacacacacaaaacacaccgaggtaaactgtaggtaacactctttgtacaagtttttggggaaaagtgcagccctgtgcaaaaccactggacctggatcagacgtggagaaacacacagccttgtaggaaagctacgtcacccacagaagggctatggtcctcttcagagccaagcagattcttaggtgaagatcttctcacaaaatgttttcagggccaggagcggtggctcacgtctgtaatcccagtactttgggaggccgaggtgggaggatcacttgaggtcaagagtttgagaccagcctggccaacatggtggaaccctctctctactaaaaaatacaaaaattagccaggcctggtggcacatgcctgtattcccagctactcaggaggctgaggcaggagaatcacttgaacctgggaagcagaggttgcagtgagccgagatcgtgccattgctctccagcctgggcagacagagtgagactctgtctcaaaaaaaaaaaaaaaaaatgttttcagggtcatttatcttcatgtaaaaccttctcatcatccttttctactttttaaaaaaatgcattcacgtctgtccattatcattactgttaatattttcagcaatctgctcctcctctttgcaaaaggctgtttgacttaatgcatggacatgagatacaatagaaatgcagagaaaacaattactgaatatgtacaaatttagatcataaaagaaagaattcccacaaggtaaaacatatgcactaacctctcttggaagctggagactcctgggtatcagatgtggaactcaatgtgcaagttgaaccagggcccttttataccctggggatgtagaaagatatcagctaaggcaatctgatatttttgtattcttaacaagaaaacacaccccggtctctctctatctctccatctctttctctctatctttctccctctcaattgagggataatagaaaattgttttgacacaatctcactttaaaaaatgcttttagtttttaaacctagggtaagttattttctactctatggctttctttttttttttttttttaaggtgatgtctagctctgttgcccaggccagagtgcagtggcgtgatctcggctgactgcaacctctgcctcccgggttcgggcgattctcctgcctcagcatcccgagtagctgagattacaggcgcccgccatcacgcccagctaatttttttgtatttttagtagagacgaggtttcaccatgttggccaggctggtctccatctcctgacctcaggtgatccgcccgcctcggcctcccaaagtgctgggattacaggtgtgagccacggcgccgttcgatggcatctttttaattcacttgctgtatatatcatcccagattttaaaaagaaaaaataaaggtggcaaatggaagagaaaaataataaacattgtgactaaaattactgaataaattcttaggatagctgaaaatcgataaataaatgcaagaccttggaaaccaatgtgtttggaagagctaaaaaactgtataatttcttgcctatcatattccaaatatcatctaccaactaaagctctaggccaaatagttttgcaagtagggtctcttaaaatatcaaaaaaatgtttgccatatctgtcggttctctcagggaatatgaggagagaagcacgatggacgcatgactccgctgactttggcacggataatacagaacaaaaataacacagcagcagtgatgggtaatattctataaaaagattaatgtgttttgctcttttgtctttccataagttcacctttatgcatgtaatttttagttacgtagaaaatcaaaaggctatgcctgaaatgttttccctggaaatcagttctgagactcaggaataaatggtctgtttgaaacttgtttcttttgcagtcagaagagtaagaatgggagaatgatactcttttaaagatctaaaaaataataaataagtctatgaattaggctttgaggaagaaactaatatacaataccgtacctattataatccaacaactctaatagtaataataataatagtaagacagccagacacacattgtgtccttcctttgtgccagtttctattttaagagtttaatgtatattaattcatttgatcctcacgacagctttctgagataagcgttattttttattatcacagcatcgataaggaactgaagcacagagaggtaaattacctgcccaaggcaatgtggctgcagatgcagctgagcccccagaatctgtgcagtttaacatgttgggatcgtcaccaccaaactaagcactgaaagctttagaggcaaatgttatcaaaatttcaaggaaggaattgtcattctctgtaaaatgttctaggggataaaaaaggagggaaaccctttgctaggttgatctgggtacaaggttctgacacataaagcacacaaaaaacattataaaggaaaggaaggaagacattttgattaggctatatgcggagaattttcttaagagaggttatgacaactttaagaatgacagttgatgacctataatgctgcaggtaggaggttaagaataaactctaggaatagatgattacatctgattaaggcaaattagaagcaacagaaagggctctagatatcagtgaaatatagagaaggacatggaggccaagactgggaaaagcaggtaaaaagaaatggaagtggaaagagttaaaaaggagtaggccaagtattgtaggtatgaaagagagggtaaaacaaatacagcatgtgctaaaaggggtatccttgaacaagagagccataataataaagaaaaatatcccagacacacaagatgacttaaacccacagatggaaagggcttgccatgttccagaaatactgacacattatcgtcgacactggggtaaacttctcagatctctgagaaaactgctgcatgcagaagagaacagccactcccaacaccatcactccatctcctaggcattgtacaaccctaatcctctgctttccacctagaatgatgggtgatccatgtacttaccaaaagtcacttcttgggtcaggtgtggtggctcatgcctgtaatcccagcactttgggaggctgaggcgggtggatcacctgaggtcaggagtttgagatgagcctggtcaacatggtgaaaccccatctttactaaaaatagaaaaaagggccgggtgcggtggcttatgcctgtagtcccagcactttgggaggccaaggcaggtggatcacgaggtgaggagatcgagaccatcctggctaacacggtgaaaccccgtctctactaaaaatacaaaaaaattagccgggtgtggtggtgggcgcctgtagtcccagctactcaggaggctgaagcaggagaatggtgtgaactcgggaggccgagcttgccgtgagcagagatcgctccattgcactccagcctgggcaacagagcgagactctgtctcaaaaacaaacaaaaaacaaaaaataacttcttctgcagcagattcacccacagtcacctactcaaagacatcgtccagcaattttccctttttcttctctatcatcacgttttctctctctctgttggaattctcctatcagtctgcaagcatgtgactatgatttcatttaagtaacagctagttttttagacctcatttgcccagcaagctactcctttgcaggaacactcttagaaaacttccttcatgctcactatatccagttcctttctctaatatttctcgttccttttctcacgtttaaaactatcaagtaacttaacctaaattgttaagtacaattgttgagctgttcaaattttcaactcctgtcaacaaaattccaaagaacaagcttctaagataagcacttcctgatatttgataacataggttaaaatttctgtaaatatcttaagagattatactcaaatccatatgttggaaaacggtgatgaataaaattttggcagtgaggaaaataaaaataactttccataatagggttatttttatctatataaatcaagaaagaattaacactttagcaatgatcagaaaagatgaggcccttggtattactgggaaaatttggaagagataattaatttgggagagcttctagaacaagtactcagaagtgttcaataataagtaaaatgacacatatgtaattgatgtcttaaggctgatgacagcagccctcctaaatgaatctgcagtttgctactaaatccatacaattcgcctcctctaatatatacgtattttgagacggagtctccctctgtctccaggctggagtgcaatggcatgatctcggctcactgcaacatccgcctcctgggttcaagcaattctcctgcctcagcctctcgagtagctgggactacaggtgcacgctgccacccctggttaattttttttttgtattttagtagagatggggtttcaccactttgcccaggctggtctcaaactcctgagctcaggcaatccgcctgccttggcctcccaaaatgttaggattacaggcgtgagccactgcgcctggacctcctccaatatttggccaagccacgcaatctttaagctcccatgtctgtccatgattgtaggtttataatttggaacttcggttatttaattaattaaaaatattcagatatatcctgcaaataaatacaaagtttttgtactcagcatctttagtgcactttcccacaaggagttgtatgtaaatgaaaaaaatagataaatgcaagcatgtaaatcaactcctattattaaccatttacttagctcaagtttatttacacctgaatgaaaagttccatttgcatcaaaaatacattcgtatactcttaaggcagtgtccggcgcagcggctcacgcctgtaatcctagcactttgggaggctgaggcgggtggattacttgggcccaggcatccagcctggacaacaatggcaagagccatctctacaaaaaatacaaaaacttagccaggcatggtggtgtgcacctgtagtcccagctactctggaggctgagatgggagaatcgcctgagcctcagaggtcaaggctgcagtgagctgggattgagccactgtactccagcctggattacatatatttgtatattcctaaggcacataatggacctaggtcaccaaaactaaaagatattctagaccaaaattttgaatgtaatttaataaccttgtacaaaccctctacagctgcacattaccaaagctagtatcactgtacctagtggcttactgcctcattcaattgaaaagatcaaactaattcaatcctgctctccaaagaacactttttctgaatgggctctcagacttttcctgaatgggctctcagattctgctttcctaagaaagtgtgttgaggtagttctttttctgaatgggctctcagattctgctctcctaagaaagagtgttgaggtagttctttttctgaatgggctctcagattctgctttcctaagaaagtgtgttgagctgtagttctacagcattgttcaatgcaaagatagggttggctgtaggttttcagaaggtgacctttatcaggttgaagaagttcccttctcgtcttactttcttgagattttatcatgaattgatgttgagttttgtcaaatgttttttctgcatttctactgaaatgagtcttgtgtggtcttttcccctttattctagcaatatggtgtatcatattaattgattttcagatgttaaactagccttgctttcttgaaataaatcccacttgggcatggagaatattctttttatatgttgctggtttctgttaatattttaagatttttgtatctggattcgtgattgataatagttattcttgtaatatctattataaatagttactgtgtggcttggccaaatactggaggaggtgaattgtatggattcagtagcaaattgcagattcatttgagagggctgctgtcatcagccttaagatatcaatcacactgggcgcagtggctcacacctgtaatcccagcactttgggtggccgaggtgggtggatcacaaggtcaggagttcaagaccagcctggccaacatggtgaaaccacatctctactaaaaatacaaaaattagccaggcatggtggcaggcacctgtaatcccagctactcgggaggctgaggcagagaattgcttgaactgaggaggtggaggttgcagtgagctgagatcgtgccattacactccagcctgggcaacagagcaagacaatgactcaaaaaaaaaaaatatcaatcacatatgtgtcattttacttattactgaacatttctcaatagaaatctttttgctatatttgagatatcccgttttcttctgcatatgcttttgggaggtaggataactaaaaatattatatataaaatataaaataacaatatataaaataactaatatgataactaatataactatatatagctatatatacctacatataactgcaatataaccataatatataaaataattaatataacatatagattagttataaaataatatatataaaactaataaaataacaccaatatataaaaaatataaaataactaaaatacattggtatagtttcttgtaataaccaaaagaaagtgttcctttttcctctatttcttggaagtgcttatgaaggactggtaatatttcttattttttattatttttgagacagagtttcgctcttgttgtccaggctggagtgcaatggcgcgatctcggctcactgcaacctccgcctcccagtttcaagtgattctcctgcctcagcctcctgggtagctggaattacaggcgtgtgccaccacacccggctaattttgtatttttagtagagacggggtttcaccgtgttggtcaggctggtcttgaactcctgacctcaggtgatccgcccgcttcagcctcctgaagtgttgggattacaggcgtgagccaccatgctcggccaatacttcttctttaaatgtttggtagaactcactagtgaggccactgggccttgtcttttcttcatgggaagattttaattactatgccttagctgggtaatacaaagatgtacctgcattatttcggattttcatcatttgtgcattctctctgttcttcttgatcattctagttaatggctttttccaactttgttgctcctttttttttttttttttttttttgagacagtctcactctgttgcccagggtgaagtgcagtggtgcgatcttggctcaccgcaacctctgcctcccgggttcaagcaattcttgtccctcagccccctccccctgcctgtccctccttcctcctgctgagtagctgcgattacaggcacacaccaccatgcccggctaatttttgtagagatggggtttcaccatgtcacccaggctgctctcaaactcctagcctcaagtgatctgccaatcttggcctcccaaagtgctgggatcactagaagcttttcaatttttttattccaaagcaatctgatgcagtttttgctatatttgagatatctcattttcttctgcatatgctattgggagataggaaagattttggaaaatgtgtaagaaaaaggaagatactaaaaacatactaagattgtatgtagggaaaggttacaactctaactttgataatgtgcattaaatcgacaaatccttgaaaagcacagctcgataaatccaacaaaaggagaaaaagaacatgtgaagagttgaatatatgtgaaagaaatgtaagttcatttttctttttttttttgagatggagtctcgctctgtcgcccaggctggagtgcagtggggcgatctcggctcactgcaagctccgcctcccgggttcacgccattctcctgcctcagcctcccgagtagctgggactacaggcgcctgacactccgcctggctaaatttttgtattttttagtagagacggggtttcaccgtgttagccaggatggtctcgatctcctgaccttgtgatctgcccgcctcggcctcccaaagtgctgggattacaggcgtgagccgccgcacccggtcgtaagttcattattaaaatgggccccatatccacgtgaataggggtcagtctcagacttagctttaattttcagccatgagaagactactgctcttcctccaacactcacttctctattttctctatcgtttgatcctgtctcctgtacaactgggtggtatttaaccatgtttaggctcaggtataacccaagctctgaaactgtaatagaaaattaagtaaatgaaaggcaaaaaatgaaagacttaataaggtttaagctgttattcatctaggaggctgaataacaatacatatacatgtttttgttgtttatgtgtatatattttttatgaatagagttgttcctattatgttgtatcttgtaataattactaatgacaaggttcataaatagctagatgttaacataactggccaaactccagtgacaagggccctgttacaatcagtaggaccaacctgctaagacctgagctcagagctcagggatggccaaggtcaaggcccagtggttgtgacgagatgccaggaaaccttacccactgcatgcctgtgttgtgccatggtgctgtaagtagtctctttgggtacactgccagtaggcttttggcatacatgtatgggctagtattttcaggccaaaaaactatccctgtctcattgtttactatttttgtgcagcaatttggttttactgttggttcttactctggtcttgccccaagttcaatactttggttcttctcttctccctaaactttccctgtcctgattccctgagaacaattcccttttctctgaattgggatcctatttctaccccttgcatacatacccctcctaattcttctgggtaaatttctatgcccattaactctagacatacatttgtaaattactgagaccctaaattgagaattatgtttgccattacttttaaaagtgtaatctgaatcccagcactttgggaggccgaggcgggcggatcacgaggtcaggagatccagaccatccagactaacacggtgaaaccccgtctctactaaaaatacaaaaaaattagccgggcgtggtggcgggcgcctgtagtcccagctactcagaggctgaggcaggagaatggcgtgaacccgggaggcggagcttgcagtgagccgagatcgcaccactggactccagcctgggcgaaggagcgagactccgtctcaaaaaaaaaaaaaaaagtgtaatctgtttttttgcctcctgaaatcacttatgtataaacacattaaagtgggtcaccgtgtcacgtcttgggcttcctgggacaagaatcaaatggcacatgcctggccaaagtgctcagatcaatctgcaaaccatggtcacagagccagtcacagagtcttacggctttcattgtagcttctctgtggaatatcttcaaggacatgtgtgtgctttaggatgttcacgtgtcatgattaagttgtaaatttcaaaaattctaagaatgcctattgttggccagaagtataaaaattggaaagattttaataaaatcatctttcaatcttacttaaataggtctatgaagtctgcatctcttcctctggaaagtaacgtaagggctgtgaagaacattgtccataatgaaactgagaagggctgttctccctgggaacagaaaggtcactgtctttgctcaacaaacagcctaaagccaggaacgcaggcctccccaggcctcttggccgcctctcaagcttcctcaataaaaaattcacatggaagacattctagtctatcttctcttccttctttcttccctttagctaataattattgagtgctgattatgttctggacacagttctagaatttctgtgataagaaacagagaccccagcagtgattctctgctggggccgatggctctcagggacatccttcaaaacagggcccatttggttctttaaaaaaaataatgtccagtttctctaaaaattctgtcatgacttttatttctttgatgttaagctttgtgtcttaggtttcagcgtgctgacgttctctgggccctgaagtcactgctgctggctggtgtgctggccacttggtcgtgctggcctgtctcccaccgggtggatgcccagcgagctctggatgctgtgtatgacaaagacatgggggttgtttggagtctgtgatgtgctattgtcctccacataatggttttctgcaagaaactagagaagtaactatctcagatttccctaataaaaacaggttttgagccaattccaggctggccctaaattcctcttcctagcacgtgaagcctgggaagctctccgtgggccttgccctcgcagctctcacccctggtctctgctcccccattcctgtctggctattggaagcacctctccattgcccagcctctctgctcatttactggaactgggcaatgccccttgggaaaagcagcacaggttttcttctcctagattttgccctatgcttcttttcagagctatttggtctctgacattctctctcaggtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgtgagtatatgcttaagttttttttgtgttttttttttttggttgagatggagtctcgctctgtcacccaggctggagtgcagtggcacgatctcggctcactgcaagctccgtctcctggattcacacaccattctcctgcctcagcctcccgagtagctgggactacaggcacctaccactgcgccctgctaatttttgtatttttactagagatggggtttccccatgttggccaggctggtctcaaaactcctgacctcgtgatccgcccgcctcgacctcccaaagtgctgggattacaggcgtgagccactgcgcccggccaatgcttaagtttttattcataatttactcaaagtcactgagctctgacttcatgctggtgattcagatttgagtcctgggaagatcatctgagatgacgtttaagccaagggtttaaatgagtcatattcagccaggtgcagactaaggcagtgcaggttccaggcagaagggaaagcacgtggacacgctgagatgcaggcaaggcctcacagccagagctggcttgtcacctggcgtgggaacacctttcctcttcagactctgtgtgttccttttaatctgcgtcagggcatgtgattgagcagcacgtgaccaaccccactgcggcatctgtcccccgtggggtgggggtggggacagagttcttttcctacagcataagtgtgtcatgtcaaccaacgccgtgtcagctgcctgcaggggcccacgggcatggggacccgacgtacaccgtgggagctgacctttctttcttctctcaggagtggagccccaacccacgcagggcgtgtcttcatggcttttcctggccaatctgataccaagatgcagtggccagaagtacctgcacttccactcctgtcaaggtgagatgccacttgctctccactgattctctatcagtgctgagctctgttctctagagctcacggattctatattgtgttaagctgtcacttaaaagtgcacaaattgtttcaatcaatcctaacatattcacccatgtaattaacaccctatcaacatagagaacacttcgaaaatcacaaggctccctgcgccccctggaagtagcttctattcttgcctacatcttaattggtttcgcctgtttttgacctttatttcactggaatcacgtatgccttttgtatccggcttcttccactcaagattgggtctgtggatttactcacactgctgtgtatagcaggactgctcccgcggcatggcagcatccgattgtgcagacaccaaggctgatgtaaccactgcagatgttctgcaggggcgtccctgggatagagactggacatgtagcaaagagctccgtgagcgtgagcgaggcaagccctgaacccacactgtatcacctacttatagggcagtgcataaaaatctgggaaacaccttgtttctcaaagtaacaacgaatatgtcagtgacttcccagcccaagaatatgctgcattcgttcgctgcttagttagtaaaatggcaacaaaagaaggcagaaccacgcacatttgtctcctgccaggtctgactcgtttgactttagtagatagtggccaacagcttcatggtagcaggcatgctcagaagcagttactttatattccgtcaacacttggtgatgttggtcttttaaattcgggtttcaatttgcacctaccctgtgattaatgaggttaagcttcttttcatgtttaacacccaaattttaatagactttattctttcgaccagttcaggttcacagcaaaattgggtggaaggtagacagtttccataaacccccagcccctccacacacacagactcccccactatctacatcctcatcggagtggtccatttgttacagccgatagacgtacgtcaacacatcattatcacctggagtccagtttacatgaggcttgctcttggtgttggacaaatgcataatgacctatatccaccaattcagtaccatgcagaagagtttcactgccctaaaaatcctgtgccctgcccactcattcctccctcccgtcacccctggctttttactgtttccagttttcctttactggaatgttggagaactggactccttcaggatgtagcctttcatgcttctttcagcaacatgcacctaactttcctccctgtctttgtggcttgatagctcatttctttttagtgccaaataacatcctactgtctggatatatcagtttacttatgcattcacctatatgcatataaaatagaggagagaatgcggtgttggagatttacgtttgggagtctaaaccatgtatggtaaataagtataatgtgtgaaaattgtaaagcagaaagctgtcaggatacctgaatacacacaaatacacacttcagttcatgctataaaatgttataaaatgtgtaagtacatacttagggctgaaaaagcacccagagaggaagggtgaagaagaggtgtatctgaaataataaaaagaaaatctgtcaagaggggatctagagtacctcatcccatgaggaactcccaaccctagtgagggtccaacggacagatccaagtgagaggatgaaaccactgcacaagcaccccctaaggggcaggtggagggcagttcccacagggacccacttcgggtacaacctgggcttgtccccagggagcaggtggagggcagttcccacagggacgcactgcgggtacgacctggacgtgtccccagggagcaggtggagggcagttcccacagggacgcactgcgggtacgacctggacgtgtccccagggagcaggtggagggcagttcccacagggacgcactgcgggtacgacctggacgtgtccccagggagcaggtggagggcagttcccacagggacgcactgcgggtacgacctggacttgtccccatggagcaggtggagggcaggtcccacagggacgcactgcgggtacgacctggacttgtccccagggagcaggtggagggcagttcccacagggacgcactgcgggtacgacctggacttgtccccagggagcaggtggagggcagttcccacagggacgcactgcgggtacgacctggacttgtccccagggagcaggtggagggcagttcccacagggacgcactgcgggtacgacctggacgtgtccccagggagcaggtggagggcagttcccacagggatgcactgcgggtacgacctggacttgtccccaggtgccagggccaagtaagaagaaaatgtgccttccttcctattataccattttctgttttggtcttgttctcttgataatataggtagggaaacagaatcagcaattattagaaggccacctctactttgtccttaaaggagttggcaatggtttgaccagaatcaaagaagtatatattttgaagattaagagtttaaaacagtttaagaaaaaaaaaatttataggtaccatttagctttctagttgaaaaccaacacatctgcctttggggtcagaagcagctatatctaggagagggatactcctctttataaaagatgaaggagttctaaggagtttatcaggtcaaaagacattccttacattttctggatggcatcctagtaatattacaacagtagtatctaactcttgctaagtacttaacaaggtgctgggtagcagtctaagggtcccatgtccaattcagtagccatggcaactcatagttatcacataactaattatatgtggctttcagcctaaaacttcctagaaaataaaactaaaaaaattagaaacaatattataaatgcaacggaaactatacaggcaatatcctattagtgtatcaaaattttaacaaactaaacacagtattaaattgcaattttttttacttttcaataaaatacttgctaaacagtcttgtctgaaattataaattgcccaaagttaaccataaatgagtcattctattgaatttaacaaacatttaactttgcaagaaataaatttttatttttcttcattatcatacagcatttaagaataataaatctgtcttgaggtttcaaatctgagatatctatggcaagtttataaaaagtacattgatcaaggtacaatttttaacattaatatacacattccataatctcatctatttaacattaacacaggcctttgttgttgttatttttttctccctacaatatttcctgactctgtaggacagtggtcctcagttgggggttgactctgtcccctaggggcatctggcaacatccggcataactgtgggtgtcacatgagagggacgctgctcaccatcctgcaatgcacagcacagaccccaccacaggggttttatccagcccaaatgtcaacagtgtcaagtttaagcaactcttaccgagtgggactcaattcccattttatgaacacctctgtgctcactgtaattctgaaaacacagactttgctaactggtaaatactatttacaagaagattcaacctaatcaatatcacttatcaaaagcagtggctgactgtaagtatcaacatgtttccagaatgaataaaccacacaatcaactcagaatgatacaaattagggtccatatcatttaatttcccttgaacctgctctgctagtttaatctgctaatatgaaagttaattaagactgttttgaaggagcgagacaatagtttcctttgcacatttttctgaactatgagaaaaatttaatgatacataaagcacctggcaaatagcaagtcctctgcaagtgctccggaaatgtttatcacagcctactaaaaacagagtttcactcatttgttcaaatttcccataagtatgtatctgcaaagattaaattaagttttatttgctcgctctcattttacaataatctctcacaaatgtcgcttagaaacagaacacatatccagggtgtgtgatacaaaattataagttagttttttccacacaagttttaaagtatcagtgtatataatacattaatgatagtaccaaatgatagaactaaatttaatgataaattaatgatagaactaaatttaaaaggaaaaagtcattctaagtttgttaagcagataaatttttctgtaatcatttacctacatattcacattctgtatattttctcatggtcaacaaactgattcaaatgatttaagttatcccaccatttaaagagaaaagtcgctgcaataattttaaaccatggcgttatcttaatttcaccactggctgcttttttcagaagttcttttagttcttcctttgacacataacaatagcttttaatctcattgggatctggattcaaagttacattcttcctcaccaacaaaatgtaatcaatttcatgttcaccccagataccatcagactgagctttgtagtgaattcgtgttaaataattaatttcttctggaggaacctaagacattaaaaaaaaaaaagtaattaaaacatcggccaccgtaacaaaaaaaatctaaaattagctcactgtattacagcgatatctcgaacagcagtatagttttaggattagaacttggttaaagcattaatctcctatcaatggtatatggaaatcttaatattatatatggaaaaatgattacatcattagtttcaagtgtttgcgtttttttcccgatcagataagtttttttttttttaatgttaaaaaaaggggcagtcactcaaactagaaatgtgacattcttctttttcttcttttttttttttttgtgagacggagtcttgctgtcacccaagctggagtgcaatggtgtgatctcagctcactgcaacctccgcctcccaggttcaagcgattctcctgcctcagcctcctgagtagctgggattacagacgtgccgccccaccatgcccagctagtttttgtatttttagtagagacggagtttcaccatgttggtcaggctggtctcgaactcctgacctcgtgatccacctgcctcagcctcccaaagtgctgggattacaggcgtgagccaccacgaccggcccgacatttttctttttcatattttaaaattgctttttggaaaatatagataagaaatactttatttatccaggtcttatttaagggggacaattccaagaaaaaaaatgatttcaattaaaccaatgagatttatggttcatattcctaagagtttccatcagaaaatcttcaccttttttgtaggtggggagttttaggtgagaactggaaaacctgtcagttaaattctacaagagctgtaacacttgaaaatactcatcttagatttgatcaattatagaaatattcaaccttatatagtgcttaacagatcaatccatccccgtattgagctaagttttgacaagtgatattaagaaattaaaatttaaataatctttattcaagatggtttgtggggctaactcataactccggaggttaccaagcagagaactacatttgaatttaaaaattttattaaaaacctttttatagtatgtttaggtttcagcttgtatggttgtgtaggagagctggttacctcttccaagggaattcctagctcagctttcagccgtctctgtgctgctcgcctcactccaagggcgtcactttcctcaagctcggctggattgcttaatggatgactacaacacgtattcgtaaaacaacctggaaaatggtaatacagagacagatcaacttttcttcaaagtaggtctgaaagatcaagaaaaagttttataagtaactgaaaaatgaaatgatttttaaggattttaaaatcagttataatgggctatcagtaattattttaaggattttaaaattggttataatgggctatcagtaattattttaaggattttaaaattggttataatgggctatcagtaattatgttgtgaaacagactacatttgtaggtaggttccttattaatacttctttaaccaaaaaagatcaaagtgtagataatacagattaaagataaatatgtaaattatacatattgcccaattgcttactagttcttattttttcttgctgttgtattaggttgcactcattgtgtaaactcactttatgcagaatataaaattatgccattcacaggatttccctttgtgaccttggctccaagaattcagaatgataaaaagtcaaattaatgtacaaacacaatattgtacattaaaagtgtactaacctggaaaggtaatcttagcatctgatctttgctgtagcagaagcttattttcggtgttgaataagaagacactaaaagctcgatgcaataatcctgaaagcaaaagaaataacaattattttagccttaagtaccagttatttgccaaattctctccctgcagttcagaataacattagtaacttgctgctgcttttgctttttcccatggtttatccacatgcatagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaaggc

SEQ ID NO: 277 - DNA, 21565 bp, Homo sapiens; identical to SEQ ID NO: 276

SEQ ID NO: 278 - DNA, 21565 bp, Homo sapiens; identical to SEQ ID NO: 276

SEQ ID NO: 279 - DNA, 21565 bp, Homo sapiens; identical to SEQ ID NO: 276

SEQ ID NO: 280 - DNA, 206210 bp, Homo sapiens
gtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggctctagggcaagggggcggggctcgagggcggaggggggcggggcgggatcgggtgggggcggggttcggggagtcggaaggcgggggctgagagggaatttctgagtgggagtgaactggtaggagcggtggggggccggcgagggtgtgaggaagactagtgagggttgggtgggaggagaagctgaaggtgtagaagcaggtgcagagggagagttagggagggatgcaatttgagagaagtggaaggcggaccgaggggtgtgtgagggcaggtgagatgataccgaaggcgagattgcagttgtctgggcgcagagtaggtgggtttgggtgtggtggatgtggagtagagttgaagcggtgcagagtgttgggtttggggaggcgttgaggggtttggggaggcattgaggcgcatgtgaggagcaggtacgattgcagtgatgggaaagaggtatctgggtggatcgcatgttggaataagaaggaggtttgctagctttggggtatgaagtattttttaaaaacgtggaaggatgggatggttgtgcttgggagagtttctgaaagatgatgctaagacagcagagcaaacttaaatatgaaggaaggggagagaggctgcttagaacttgcaaaatctgtggcagaaaatctcctggggacaagggattggtaggggtgggacaaggcggcaggtgtgaagaaagtgggtggagctgtacagtaattttcggtgaatgtgatttggtggactgtgccaggggtgaggatggggcagagaaaggtgttagtttgggagacaagttgtttgataggctgtatttattattttttataaaaatgagaaaagggtctcactatgttgcccaggctggtctcgaactcctggcctcaagtgatctgcccacctctgcctgactgatgggattacagacgtgagctatggcgacccgtgatacgctggattcattatgttaaacttgatctggagtcttcaagggagtgtccggcagcagggtatcccaggaagagacatgcaccataccttgggataggacattttgcatagctttgaatttgctagtactttgctgtgggcagagtgcagggagtggtaggagatgaccaggcaaaggcagaggaggggttagattacaaatggtgtcctatgccccatgaaggagtttaagccctgtaattggtagaaggtgttgggacgtgttaaagagagtgttagacagaagttgtgaaggggtagtgataaagaattacagatgtgggaaataggaaatgaagaccaacgaaccaagtatgtttggggttggaggtaccaaggaaattcagggtagagcatatgagggcccctcctatatggacagaaggtggaaatagcaaatggaaattagttgtgttcgaacagtcttagttctatggggccccaagaaggttttttgtgtttttttttttttaaagtgcattcttcctgtcttacttgtataccctagattttttggcatagccttgaaataaaacactccatttttttcttactcataagttctttttttttttttttttttttttgagacggagtctcagtctgtcgcccaggctggagtgcagtggcgccatctcggctcactgcaagctccgcctcccgggttcacgccattgtcctgcctcagcctccggagtagctgggactacaggcgcctgccaccacgccccgctaattttttgtatatttagtagagacggggtttcaccgtgttagccaggatggtctcgaactcttgaccttgtgatctgcccgcctcggcctcccaaagtgctgggattacaggcgtgagccaccgcgcccggccattcataagttctttacacatttatcagaatgaatttggacagtattttatgtttttaagaaggaaaggataatgcacatgttttttcttttccgagaacttctactgagagttaaaggttggagtggtgaagtgatggtttaaaaaaaaaaaaaaagaaaagaaaagagagagacagaggaagattttaacattaaaagaggaatttagggaatggctgatggtcatgacacggtcggcagaggaagttttgcttactagccacacttaggcttctgagtagagtggatattatgtcattgctattatagcatgtgtttatttcacacactgcttttgaagattgggtggaaactgtcagatgtgaggcatagcatgaatgaaaggtaaatagcatgagtattagaaagtagatgaggaagtttaataattttaatgtgcttcataagctctcatggactttcacgtatcaattagtaaaagacgtaactaagtgatctggctttcagtctcctagttctctacagtgtaccctcagttttccacgtgcttacacatgcctacatttgtactgagagaaaaggaaatagttttttttttttttttgagacagtcttgctctgttgcccaggctggagtgcagtggcacgatctcggctcactgcaacctccacctcctggattcaggtgattctcctgcctcagcttcccgggtagctaggattacagacatgtgcccagctaatttttgtatttttagtagaggtggggtttcgccatgttggccaggctggtctcaaactcctgacctcaggtgatccactcacctcggcctcccagagtgctgggattaaataaatagttttatgtggctgggtgtggtggctcacgcctgtaatcccagcactttgggaggccgaggtggatggatcacgaggtcaagaaatcaagaccatcctggccaacatggtgaaaccccatctctactaaaaatacaaaaaattagctgggcatggtggcgggcgcctgtagtcccagctgctcaggaggttgaggcaggcgaatcacttgaacctgggaggcggaggttgcagtgagctgagattgcaccactgcactccagcctggcgacagagcgagactctgtctcaaaaaaaaaaaaacaaaaaaaaaagaaaaatattttatgtaagtagggatgtgtaagctgtagtgatcagtctttgttgcagaatggtaaatgatgcgtggatgagagaagtggggtgatgggatatttcttccctttaatgccttaatttgcatttccaaagcacctttaagcatctttttatagaactcccatgatcttctgatacctgtcttctcgcagaccccagaaagagaatacaccaattttcgtatcatctattccattgttgccgaatatttgagttgtttcaagtttggggcaattgtgaacaaagctgctatgagcattcctatacctgtcatctggtgcccatgtgcacaagtttctctaaggtatacacctaggaatgaaattgccggtttatagctagggtgaccatttgtcctggtttttgcttattttcccagcgtaactgtaacacttttagttttcaaaagtatctagggttagatgatgaattgtatggtcacctagtcataaggtatgcttgtcttcatctttactaagtaccaaactcttctaaagtattgtaccaggttacactccctccagcaatatatgaattcccttgcttctcgccctctccaatctcagcctttttagcttttatgattttagccaatatggtaaattttgcgtttacctgattagtaatcagattgcacagctcttcatatatatatatatatatatatatatatatatatatattttttttttttttttttttttttttttttttttttgagacggagttttgcttttgtcacccaggctggagtgcagtggcgtgatcttggctcactgcaacctctgcttcctgggttcaagcgattctcctgcctcagcctcctgagtagctgggattacaggtgcccactaccacaaccagctaattttttgtatttttagtagagatggggttttgccatgttgggcaggcttgtttcaaactcctgatctcagttgacccgcccgtcttggcctcccaaagtgctgggattacaggcgtgagcctctgcacccggccagctcttcatatacttttttagccatttagatagcctcatttataaagttctgttcaagtctttcccaccctgcttttaaaagttgggccttgtatcttttattgctatttagaagttctttatttactgtgaatacaagtcctttgtcatgtgtgtgtgttgcaaatactgtggcttgccttttcactctctttatggtgtcttttaatgaacagaagttcttaattttaatggagtcaaatttattggtctttactttatggttagtgccttttgtgtcttgttttaagacttttcctaccctgaggtcaataagatattctcctatgcagtactatctttttaaagctttgttgaccttaaacaatgtataactatgagtaaaatacactcttcttgaccccagcctcaccattacaatctatttttgctttccttcacttttttctgttctctgtcttgaatttttacttctctgcagctataactaagagccaggtgctgacttctcctgtctcttaggagaaaatggtcatatagacagaagttcagccagattagattttacaggtctccagctgactgtattgccctttttccttttatgagctagcattttattgtgttcctgctatgtgtctgccatcatccttgctgctttcatatttgttatctcagtgattcctcttaacggttctgtaaaacagagaagtattctcatttttacagaagagaaaacagagacttagattgatttagtagcatgtccaatatcccctagcctaggtagctagcagaatggggactggatccctgactctgatacttcccatcacagcacacctacttgttgattaaaatgtcagaaacctgttttttgataacatccaaaaccaaaaagaataactttcttactcttgatgtaacatgccttaagtaaagcacacaaagctaactattgtgaaactggataaaatacctctctgtatatagccagtggaccttaagtggtccatggctggatgacagaaggtctgttaacccttaaaaatgtataccagtgtatatgggtacatgtgcttattttttagagtagagctataatatttatgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcaatggcgtaatcttggctcactgcaacctccacctcctgggttcaagcaattttcctgcctcagcctcccaaagagctgggattacaggcatgcgccaccacgcctgctaattttttgtatttagtagagatggggtttcaccatgttggccgggctggtctcaaactcctgacctcaggtgatccacctgccttggcctgtcgaagtgctgggattataggcataagccaccaagcctggccttgtatctctattttaaaaagttttttaaaaatcacattttttggccgggcatgatggctcatgcctgtaatcccagcactttgggaggctcaggcagctggatcacaaggtcaggagctcgagaccagcctggccaacatggtaaaaccccgtctctactaaaaataaaaacaacaacaacaaacaaacaatggcatggtggcatgtgcctgtaatcccagctactcagaaggctggggcaggagagtcgtttgaacccgggaggcggaggttgcagtgagccgagatcacgccattgcactccagcctgggcaacagggcaagactctgtctcaaaaaaaaaaaaaaaaaaaaaaaaatcacattttttcccttaatacattattctcggtctttgtcatcaaaaaccaactaaagctaatttgtaattagggagaaatctaggattgaataggaatttttaaatgccaaaaaaagacactctaaatttagttgattatttcttaagtgaaagtgcttagttataatacatcattactaatcagtgtaccctggctccaaagacctgatgacttcaaatgacttttcatcttgtctctaaattcctctgttttacaagggatcaaatttcctgtgaggttcctaacagtgtgattaaattttagagactgaaactattgagcacttaaatgcagggataactatgcaaacctaattcatgggtttcaccaggagatttgggacctgtctctactaatttatgatgatgatgttgaaactaatctttgctagggattatggaaaccataatagtttattgatggttcagttattgtttgttgaagcacatttacacaattatagtttaatgacataacaaggatattgtcaactaggagagcatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagacagagtcttgctctattgcctaggctggagagcagtggcacaatcatagcccactgtggcctcaacctcctgggcggctcaagagatcctcttgcctcggtctcccgagtagctgggtctacaggtgtacaccaccacagccacctaattttttatttttgtagaggtagggtcttgttgtgttgcctaggcttgtctcgagctcctggcctcaagtaatcctccttccttgacctcccaaagtgctgggattagaggcatgagccattgtgcctggcccaacttaatttctttatcccttttgagcatatacctgttctagtcaggcacatggacttggtgtcccttttgtttgacagctcattcttagcttctgttatttcactttgatttccttcattcattccccgatacatttatttagcaaataggcattgaaaccctcttatgatcaagttgtggtcttgggaaatcttagggtatacaaagatgaatcaagcatgaatcctgtttttaagaattttatagtctagtaggggtgacaaggttaatacacaagtaagcataatactaagtgggaaatgaatgtcaaaacagtaaaaaagctaaaagcttcctgttagacaaagatgtttggggcttttgagaagttgtttgcactgggccatgaaggatttgaatttgggcagagggacggtggggcacttatccaggctcagcattatctttcaaggttcagtttcagtcccatccatccaagagatgttcatccatcctccacgtggtttcagcaaggtagtatagtcacagttgtttccagacttcttccttctgtaatcagaggaacacttcctttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaaaaaatccaggttttccaacagtgatccctttggggaaaaaaaagaaagaaaaagccaggacttatgaaagtaaaatagttaaaaataactgttagcaagtaaaactcaggatgacaaaagtgtaaactctattattaatctttgtttttttctaccactgttttttgcctcatccataatctcatgacttgagtgttatgacattgattttgaaacaacacacacagctttagtaaaagcttagaggaggcctcgcataatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttattacatttttaaggtataaaatgacaatcttattgaaatgtgttggtaatggatataaacaattgttttatggatataaatgattgtgggtaaagatttgtgggctgggtgcagtggctcacgcctgtaatcccagcactttgggaggccgaagtgggcggatcacgagatcaggagtttgagtccagcctggccaacatggcaaaaccctgtctctactaaaaattcaaaaattagctgggcgtggtggtgggcacctgtaatcccagctacttgggaggctgaggcaggagaattgcttgaatctgggcggtggagattgcagtgagccgagatcatgccattgcactccagcctgggcgacaagagcaagactctgtgccccccaaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttgccatgttgcctgggctaagtacagtttagaaacaattgaaacatgcatgttaggaaaagttatgctcctcttgtttggataccatgaacccttgaaatggaacctgttttcctcaatgctttagatcagatcagcccatggaaaggcaaaccacctggtcctacaaattggataggaccaggtggtttgcctttccatgggctgatctaaaaggctggagtgcagtggtgtcacctcggctcactgcaacctccacctcccgggttcaagtgatgctctcacctcagccacccgagcagctgggactacaggtgcacaccaccacgcccggctaatttttgtactttttgtaaagatgaggtttctcgatgttgcccaggctggtctcgatctcctgggctcaagacatccttccgcctcggcctcccaaggtgctgggattataggcatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggcgtgcactcttgcctccacttcatgtccctttactcactagttgaagaactgaagaatggatttggcactaatagcttcagagtttttaacaatagaagtttggatgggcaatttttttttttttttttttgagacagggtctcactttgttgcccaggctggaatgcagcggtgtgatcatggctcactgcagccttgacctcctaggctcaagcactcctcccacctcagggtcctggaactacaggggcgtgtgccaccatgcccagctaatttttgtatatttgataggcatgggttttgccattttgcccgggctggtctcgaactccttggctcaagcaatctacccaccttggcctcccaaagttctgggattacaagtgagagccgctatgcctggcccaaaatgatttttgagaagtacatttaaagttgtagagaagggtctttcatttaaatgcccacagggtgcatgaaaaatacaaggtgatttatcaagataggctctttggctcatgcctgtaatcccagcattttgggaggccgaggtgcatggatcacttgaggtccagagttcgagaccagcctgggcaacatggcgaaaccccatctctactaaaaatgtaaaaattagctgggcatggtggctcacgcctgtagtcccagctactcaggaggctgaggcaggagaatcgcttgaaccttggaggtggagattgcggtgagccaatattgtgccactatactccagcctgggcaacagagcaagactccatctctggaactcctgatctcaagtgatctacccaccttggcctcccagagtgctgggattataggcataagccagtgtgccctgcctttgatgatatttcaaagactaagtaacatctgaagaattttatgtcttttatttatttatttagacaacgtcttgctctgttgctcaggctggagtgcagtggcacgatcttggctcactacagcctccacctcccaggttcaagcaattctcatgcctcagcctcctgagtagctggaattacaggtgcctgctaccatgcccagctaattttgtattttttttttagtagagatggggtttcactgtgttgatcaggctggttttgaacccctggcctcaagagatccagccacctcagcctcccaaagtgctgggattataggcgtgagccactgtgcccagcatatatctataatttaaattagaaccctcaatcagagaagtctaaataggctgaaaaagaaactcatttatttaaaaaagaaaaatgacatgcagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcagggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccaccttagcctgtcaaagtgctgggattacaggcatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgacagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgaatgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaagtgagcacaagtaggtgatagccaccattctttatggtaatattatttaggtcttaaaatcagtcagaggcaaattatattatttgaaaaatgattgcttttcacagactaaattatccttatattatttttccttttttttttttttttgaggcttagtctcaagctgttgcccaggctggagtacagtggcataatctcggctcacctcaacctctacctcctgggttcaagcgattctcctgcctcagcctccagagtagctgggattacaggcacctgccgccatacctggctaattttttttgtatttttagtagagatggggtttcaccatgttggtcaggctggtcccgaactcctggcctcaggtaatccacccacttcggcctcccagagtgttgggattatagctgtgagccactgtgcccagcctctttttttattattttaacatactttgaaaatacttaatacctatctagaccagacctcttttgtaccagatatatttattttggtctagagaaaatgaagacaacgtattaaagttgggtgtacccaatgcaaatatctgtttaaattcagtgttcagattggagttttgtgggcaaaatatttaacaagaattgtatttaacttacctgtgattttgactcacatagacttagctgaaatgaaacatagtaagtacagatttaaatatgtatgtatttgagtagaaatctttccacctgtatgcaggtagttttttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagagttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtggggaagtaaagagctctgggctggtgaggctggtaggggcggtcagtgaagagggctttgttttccttgtctgaggcttgtctccaactgaaaggcctcctttcctctcctgtccctgggtgaatctttgctcaagtcccctgtattttcatcacagccatcacccctcccctttccacccgtgtctactgccttttcctctgcagtttgtttctgaactgactgaaatctctgtcagtctccgtgttaaaattcccttcaagactcacctccttagagaagccctgtggatggactatacccagcttttacccttctattgatgatttttgatccatctatatagctttaatgaaataaaacttcaaaaacctgaattttagtattaaatatgctgccactcatataataagtgttcaagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactagagagttgctgatgggctcttcttcattcaggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataactttaaaagcaagctgttccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggtgaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcctccagggctttcactatagggtttaactctttggtgaatcctcatatcgaaatggtaaaacataccccaaacataccccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaagtagatagggcaggtaattggaaagaagagaagatgaagtggaaaaagagaagaaagaagggagagaggaagaaaaaccatgcctgacaatactgatattttacctgtatagatgggtctatgcttactgattattctttgagtctttagattattctttgttgtgacactgaatatggaaaggaatactgaaattttatgggctggtaaaaaatttccatgcccttgtaatttccaatgatctgtcaaacatacatggagagtttcctgttaactcatggtctcagataaattatgcaccctttattttctctttttttgtgagacagagtctcactctgtcacacaggctggagtgcaatggcacaatctcggctcactgcaacctctgcctcctgggttcaagcaattctcgtgcctcagcctcctgagtagctgagattacaggtgcccgcctctatacctggctaatttttgtaattttagtagagacagggtttcaccatgttggccaggctggtctcgaactcctgacctcaggtgatctgctcacctcgacctcccagagtgttgggattacaggtgtgagctgccgtgcccagcccctttattttcttaacacacacacacacacacacacacacaccagtccccttgtattcatgctttagttatctttttagtgtgaagatggtgtgcttcctatgctgatcctgcaagatcactggataggagagcagagtttggtttactactctctgcctgtttggtagtgcttctactgctgtttgagttgattcttccaatgtaaaggctgtgaggatgtatgggaacactaatctttgatattaactatgaattatgggtgcttgtggaggtacagctttatttgtattatcacatactaggggctaaggaaaattacccctttttgacttaaaatatgaccttggagtctgtttttttgttgttgttgtttatttgttttttgagatggagtctctgttgcccaggctggagtgcagtggcacaatcttggctcactgcaacctctgcctcctgggttccaatgattcttctgcctctgcctcccaagtagctgggactataggtgtgcgccaccacgaccggctaatttttgtatttttagtagagacggggtctcaccatattggccaggctggtctcaaacttctgaccttgtgattcgcccgcctcggcctcccaaagtgctgggattacaggcgtgagccactgtgcccagctggagtctattttttaaagttgatttgagaaacaagtttatggtatgattttaaacaactaaattggcaaagggaagaaatttgataaaatatgttggaagtgtgcagtgatacaacctgtcgcaatttaaaatgcctgtttccgttacccagcaatttcacttgtaagagtttatcctatagatgtatttgcacatggaagtgtacatgtgtacatttttatgtagaaacaaatgagtagtaataacatcaatattaattaggatgagactgggactgggttgagaagttgagactgctgcaacttctttttttaaggtgttatttgtgtgtgtgtgtcggggctattaatgaaagtgtcttaatgaatctggttacaataactacctttggagacaggatttgaaggtgttagaccttcaaatgtgagggacacttactttctattaaaatgtctttgtactgtgtggaattttttaagaaaaccatgtgtatgtatacattaaaatcaacaaaatagtgctcacattgaggagtttaaagctatatgtactcgtaattacacttacatatttttcccctttttttttttttttgagacagagtctcgctctgttgcccaggctggagtacagtggtgccatctcagctcactgcaacctccacctcctgggttcaagtgattcgcctgcctcagcctcctgagtagctgggactacaggcacgtgccaccatgctgggctaatttttgtatttttagtagagatggggtttcaccatgttggtccgcctggtcttgaactcttgacctcgtgattcgcccgcctcagcctcccagagtgttgggattacaggcgtgagtcaccgtgcccggcctttgttttttttttttttctttctttaaagagaagttcttgctctgtcgcccaggctggagtgcagttatgcagtcagctcattgtaacttcaaaattctgggcttcaagcaatcctcccacctcagtctatccatagctaggactacaggtgtgcaccactgcacccagcctttcccccatttttaaaacatgtttatgtacctaagctcatttatgcctttgagtccctaaattaggtggtaggcaacaaattcttggtcgcctcactgctctgtattttctctccaactccttagactcttcttagcataaactgtccagtgttctgatgattcagagctgtgattccaaagttggggtaccatcagaattcttgaagattggttacaaattaagattcctaagttaatcccagacctattgagtcaaagtctgtgggtgagacttaggcatgtgcattttttttagaagatccatgggtaattcatcagaatcaggttaagattcttcgcacctggttaaaaagcactgtctggagagcaattcttggtaggaatcttcttctactaaaatgccagctgttatctgtgcacccgcacccccagatcccaggagtgatgtgcatgtggcatatcaccaggctgaatgagcagatcctctacatccaaggaaaagggaatgttattctgaatagtcacatggttctctctattgaattagaataataatggtaatgacagagatgataccaaataagatgtctatgttagaaccaacattttctgccaataacattacaagtaaataggagaaatcaagagttggtcctttgaaacatcaataaaatttagaaatctgtagctagactaatgaaaaagaaaaagacaaattatcagtaacaggaatgggagaggagatagcattgaagacataataaggataataaaggaatattatgagcaagtttatgctaaaaaattgggtaactgagatgaaatcagaatttgtggaaagcccaaattaccaccaacacacaaacacacacacatgcatgcacacatgcacaatctgaataggtctatagcgagcaaagaaattcggttcataatttaaaacttagctacaaagaaaactccagactcagacaactgacaacataatagtgatgaaatctatcaaatctttaacaatacaaatgttaaattctttcagaaaatagaagaggagggaacacatcccatttcactttatgagattggctttgctttcatactaaaactagccaaaaactggccgggtgccacggctgtaatcccagcactttgggaggccgaggcgggcagatcacttgaggtcaggagttcaagagttcaagaccagcctggccaacatggcgaaaccccatctctactaaaaatacaaaaattagccaggcatggtgtcaggtgcctgtaatcccagctactcaggaggctgaggcaagagaatcacttgaacctgggaggcggaggttgcagtgagctgagaccatgccagtgcactctggcctcggcgacagagtgagattttgtctcaagaaataaaataaaaacgaaacaaagactttgcaagaaaaggaaactatggaacattcctcatgaacataaacacagatttttttaattagcaaattaatccagaaatatataaaaaggataatacattttgagttttacctagaaaagggtttatccagaaatacagttgatttaatattgtgacatgaagcaaatatatgatcatcttattaagataaggaaaaacaatcaacaaagctaaaaatccattaatgatataaactcttagcaaactaggaatagaagaaacttttgtcaacctgataaaagacatttataaaaagccatatctggctgggcatggtggctcatacttgtaatcccagcactttgggaggcggaggcaagcagatcacctgaggtcaggagttcgagaccagcctgaccaaaatggagaaaccctatcgctactaaaagtacaaaattagctgggcatggtggcacaagcctgtaatcccagctactcgggaggccgattcaggagaatcgcttgaacccgggaggtggaggttgcagtgagccgagatcgtgccattgcactccagcctaggcaacaagagcgaaactccatcgcaaaaaaaaaaaaaaaaaaaaaaaaaaagccatagctaatgtcattattaacagtgaaagactaaatactttcttcctaaggtcagaaataagacaagaatatccccctttcatcatttctattcagcattgtactggagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaaggaactcttacaactgaataagacaaacaacccaattaaacaatgggtgttacaggttgtgttcctcaggaagcagctacggataaagctcaggtatgggatatttagtaagggatgcccttggtattaaggcttttgagaaggagggcaacaaagcagcactggatggagggagatgttgagcagtgatgcggcccaggaacagccttggatgacttcacagattgctctgaagctggactggaccttcggaatttccctgagttgggccctgatggtgcctttttatttctgcatcactcagtaatgtgggcctgtatcactggatatggcccatgctaggaaggatatatcttggccagtgtgattctctgcagcttgaggcaatccctggagggagtgatagctgaatactgatttcccatagcattcttagctgagacaataggtttttcactgaaagaggatctgacaatatattgcagtgaccattgtaatgggcaaaagattctaacagaaactgtacaaaagaagatatatgaatggccattaagcacatgaacaacgtcattagtcatcaaggatatgcaaattaggccgggcgcggtggctcacgcctgtaatccagcactttgggaggtcaaggcgggtggatcacgaggtcaagagatcgagaccatcctggctaaaacggtgaaaccccgtctctactaaatatacaaaaaattagccgggcgtagtggcaggcgcctgtgttcccagctactcgggaagctgaggcaggagaatggcgtgagcccagggggcggagcttgcagtgagccgagatcgcgccactgcactccagcccgggcgacagagcgagactccgtctcaaaaaaaaaaaaaaaaaaaaaaaaaggatatgcatattaaaatcacaatgagacacttccatacactcgaatggccaaaattaaaaacactgataataccataccaagtgcaactggaagtgtaaaatggcacaagcaccttggaaaacactttgcctgtttcttataaaataaacctacacttaaccgtatgcctagcagttccactcctaggtatttacccaagataaatgaaaacatgtacacaaaaaagacttgcatgaatgttcatatgaagtttattcatagagccccaaactgtaaagaactcagatgtctgtcaacaggtaaatggataaacaaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatggatgtatcatttgcccaaacttttgtttttttcttttttttgagacggagtctcactctgtcatccaggctggagtgcagtggtgcatcttggctcactgcaacctccgcctcctgggttcgggagattcttctgcctcacctgagtgagggattacagccaccacacccagctaatttttgtatttttaatagagacggggtctcaccatgtttatcaggctggtctccaactcctgagctcaagtgatccgcccgcctcagcctcccaaagtgctgggattacaggcatgagccactgtgcccgccggcctgcccaaactttaaaaggttgcgtgtttttgcaaataaattacacctcaatgtaattatacttaagtaaaggtgagttgttttttaaagtaaaacttttcataatggagattattttcatgaaggatattgactgcacttttaattttcttttcttataatgtcttcatctgattttggtatcagaattatgctggcttcataaaaccaattgagaaatatttcctcctcctctattttctgaaatagatcgtgtaaaattggcattgtgttcttaaatctttgaaataattcaccgctaaagtcatctgggcctggtagttcttctagggaggttttaaataatgaatcattttctgtagtagatttagggttattcagattttctgtttcttcttgggttagttttgataattttgtctatcagtgaagtccatttcttatctctgttgtctaatttattggcataaagttgttaataatatttcccattattttaccgtcttaatggtctgtagttatatctctactttacttcctgatattggtgatttgcattttctttttcttaatcagtctagttaggggtttctaatgaagttaaacatatacccatctaatgacccaggtgttccactcctaggtatttaatcaagagaaatgaaagcacatattctaaaaaataatgttcatagtgatttttaaaattttagccctgaacttaaaacaaatgctaatcaattatagagagaacaaataaaattttgtatatttacagtaaaatactactcagtgataaaaattaatgaaatactgacagatacaacaatgtatgtgaatctcaaaaatattgtggagagtggaagaagccctacataaaaaaatcatagtgtctgagtccacttaaatgaagttccagaacagacttaatcaaatcgtggtggtagaaatcagatttgtgattgcttaggaagggaagtggaaaggtatgagcagggaactagcaggagagaactttctgggttatggagtggtctgtattttgataggggtgtgggttaccagtgtatgcatttatttaaagctcatcaaactgtacatttcattgtatgtaaaatatggctcaacttagttgtacaacaacgggaatgtagtcagtgccacttaactgtatgcttaaagatggttaaaatggtaaattttatgttatttatattttgccacaattgaaaaaaaaactgtttgtttgttatatttggttttttttgagacgagtcttactgtgtcgcccaggctggagttcagtggcacgatcttggctcactacaacctccaccccctgagttcaagcagttctgcctcagcctccctagtagctgggattacagccgtgtgctaccacgcccagctaatttttgtatttttaatagagatggggttttgccatgttggccaggctggtctcgaactcaagtgatctgcccgccttggcctcccaaaaaagtactggaattatagggatgagccaccgctcccggctgaaaaaacaaaaacaaacaaactaaaaacaacaactgtaaatgggaagatgtgaaggttctaaatgtgcaaacatttaaaatgtgtatttccccccataaccgtgtgctgttctattattatttatttaccatttatatgctaaagtaagaatgtaatttagaaactgataagaaagtaccaagtatgagaaatgttacattcgtatattcaacagatattaatcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatgatatagtgctccctcacagaaccaattacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttttttttaatttttaatttttgtttcttttgagacagaatcttgctctgttgcccaggctggagtgcagtggcatgatcttggcttgctgcaacctccctctcccgggttcaagtgattctactgcctcagcctccagagtagctgggactacaggtgcgcaccaccatgcccagctcatttttgtattttttaagtagagacggggtttcaccatgttggccaggctggtctagaactcttggcctcaaatgatctgcctgccttgtcctcccaaagtgctgggattataggtgtgagccaccacgcccagcgaccctttttttttttcttttaataaccttgtattctttgtagagatggaaagaaatagcgggactggggagggggagtgccaccacaactaggtgctggcaactggtcatgctccaaatctgtcttatatagtgactattacaacctatagtgactattactaagcaagccctaatagtgaatactgggcagataattttcctcccaactgattttaaaattttggtcccgtcttgtcagtttatgcccagggaagtatatagcaaacataaatgtcgtttattatgtgtgtcagagtaaaaaaggtttcagattagacaatggtggaacccaccttgccattgatggtttctttacatgtcgtgtttgtggtcattgaggatatacatgaaaataaaagacagttgacaatattttgggacctgtgaattggagaaaccagttcccaacttcagagcagtttattcatttgtttattcatttattcaatagatacacttttgaagctggggctacagcaatgaacagtctctgccatcatgatggaacttatggtttagtaagggaaacagacaaataaatgatatgcaatatttcagataatggtcagtgcaatgaagaaaaataaagccaaggtatggagccgagcacagtggctcacatctgtaatcccagcactttgggaggccgaggtgggtggattgcttgagcttaggagttcgagatggcctgggaaatgttgcgagacccccatctctatgaaaagttaaaaaattagctgggcgtggtagtgcgccagtatagtcccagctacttgggaggctgaggcgggaggatcacttgagcccctggagatcgagctggagtgagctttgatcacgcccccgctctccatcctgggtgacaaagtgagtggtgtctcctaaaaaaaaaaggtatggagattctggagtggtgccagtggagtacagtttcagagagggatggtcagggacagcctttctgctgaggtatatcaagctccaagtgaaaggagggacaaaccatggggaaagccagagagtgaagggcttggcatcagcaggctggaagttcctccatctcactagttaggtgaccttagagaggtggccttgtagcatggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaatttttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaactttaacaacccgagagctagacaacacagacactattgtgcacttttacagatgaggaaacctgaggcttagagagcagcgtttaaatctgggtctttctgtggtgcaaatatgaacatatgaatgaaaaatgctgaactgttttgtttttaacacttgggattactaaaatggtatgtttttttaagcagtctcatgaaagatgtagatgacttaagaagtatggatctataggggattatggagagagagggttatatgtccctgatcattgtgaacagataccatggaaatggcttacaaaacccctttttgtgtcattgtcaggaggaggatatgaatctaaatactcctggctctgattttgtgcaggaattttcatttatttttgtccagttacttagactaaggctaacaaatatatagtttccttctgggcagaaacagaagtaatcacaaagtaaaataaagcttcttaaaaatgcattgtcctagatttaaagaatgtttccttagaaaatgctatcttattttgagatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttttacatagaataatgtaatgaacacctatatgccttttacatagactccccaactgttaacattgtgtcatgtttactctctctctctgtgcacattaacatacgaacacccttaggtttgtttttttctgaatcattggagagtaagttactctccaatcataacactttactcctaaatttcaacataaagacatcataacactttactcctatatttcaacatatatctgctaaaaacgaagatattctcctacataatcagaattatgttcactcaagaaatttatattatatctagtttatatattgcctaattctgagtatacattaccctaattatcccaataatatccttcatagctgtggatattttgtaaaagtccagaatccaaccacggatcacagattatatttatatttagttttcatgcctgtttagtcaccttaattggtcctgccccctgcctcccttcttttgagaaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggctgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctctaaaaaaaaaaaacaaaaacaaaaatcgacagaacaccatagctaattcttgtttgggaagtcttgagatatactggctaggagcaaactcaagagccagccatagcccagttcctctgccttgagttagttacttgatcattctgagcccctgtttcctcattagaaaattagagataatggcagcaccatcctcttgggttttatgggaatgaaatgtgagggcacaagtaaacaccctggcacaaggtctgcagaactatggtaagtgtactacaaatgtcagcagtgttatggtttagcatgtttgatattgttatccttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggtagcgcatcctgtaatcccagctactcggaaggctgaggcaggagaatggcttgaagccgggaggcggaggttgaggtgagccgagattgcaccactgcactccagcctaggtgacaagagtgaaactctgtctcaaaaaataaaaataaaaaaacaaagcagaaaagattgggggttgggggaaagaaggtgagccccatccctgcaaaagcccaaagcatgattgaccatccaaagagatgtaacttcactaaaactgtgcttgtctgggtaatagtgacctctttgtagcaaaatctaatgatcatttttaagtgtttatcaaaatctaattggtatcttttaatccacaccaaataatttctcttagtcatatttgatcttgtagagaatcttttttcttgaagtgttcttttcctttggcccctgtgacaccatattatctgtgttttttctctaccacttctttccacatatttttgttagccccttggtcctctctccattccctaaatgtttcttcagatgtctgtcgtggccctgtgtttgttactttgccttgtagcttctactgagcttctgaccctagatacaaataactatagagcttttccaacgagtctacccccgaggcacctcaaagttaatatccagaacagctcatcaaccttgcactgcttcctccacccaaaacaacagccacaacaataacaacagaaatcccagcaaacaaacagtatcccacctctcctggaggatttcctatattcagcaagtggcacaccgttcgctactcactcagttacacaaactagacatttggagccatcctctgtcctattctttcacaccaaggaatcaccaaaaacacattgattctaaatcataatatgtatcttgaatgctaaatttatcgatgcatccccaccagccagccccactcagatctgctgttataatgacctcaatctaggcttcaccctttttcctccaatccattttccatactatagcctaagttacctttttaagttataaatctgatcacataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagcaggtggagtctctctcatgctttgaacccttcctcctccttttgccatttcatttctaaccaagtccgtaaaaggttctctgcttttaaggattaatgtgattagatcaatcatgcccactcagataatccaggataaactccccatctctaggtcggtacccctagtcacttctgcagagttctttttgctacaacaggtatagtatgtttacaggttatgggaattagagcacagatggctggggcgctgctgttgttgtgcttactacagagcctgtgttttttcttcctcagtactttctccaaaaagcttttccactggtttgtagttccattggtacttgtttaattttaaatagtattcctttggttttgctagataaaactattgtaagctactagtacttgacaatgtatttgtgtaaaattgaatgagtgaatgaatatgtattatggctctcaaatctgataaattgcaaaatacaatagtaaaacaaactccagaaagacaaagcaccatgaaacgtgtcaacagagagaacaagaattttagaggaaattagctggacgtggtggggtgtgtcagtagtcccagcactttgggaggccaaggctggtggattcttgaggccaggaattcaagaccagcctggccaacatggcaaaaccccatctctaccaaaaaaatacaaaacaattagccgggcttggtgatgcgtgcctgtagtcccagctactcgagaggctgaggtgacagcactgcttgagtctgggaggctaaggttgcagtgagccgtgatcatgccaccgcactccagcctgggcaacagagtaagaccctgtctcaaaaataaaaaaataggctgggcgctgtggctcacacctgtaatcccagcactttgggaggctgaggcaggtggatcacaaggtcaggagatcaagaccatcctggctaacacagtgaaaccctgtctgtactaaaaatacaaaaacaaaattagccaggcatagtggcgggcgcctctagtcccagctactaaggaggctgaggcgggagaatgtcgtgaacctgggaggtggagcttgcagtgagccaagatgacgccactgcactccagcctgggcaacagagcgagactccgtctcaaaaaaaaaaaaaaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatcttaaatacagatgtttagagttttttttttttaactcaggaatagtgtgcttttattaacggtattggtgattgattttgaatgtttttacttcaaaaagccaaatctcctggtgggtggaattttatgaagcacctgttaagctttagggaggaggacctttttggcagcaatccaaaatacatatttaaacaatgagcctgccaaagtcaggaaattataaaacagttttgaaattgcagaatctgcttttttttattacccctcaggtttcctttgcagcttggttgtaagttctttcacatgggatttactaatgttcttactatttaaagaccaggtttaaaaaaataaaatcaagtttggagatctcttcgggtttatgtgataaaagaccattagattttaaactgtacagccttccaaagaatctaggctcacgctccgcacacctcttggaggaatctattacacactggctcatggctggctcctttgaatggcattgcccctcagggtctccagttttcctctgtgaagtgagcagtaagacctggtgtgtggagcgctgctaggtgaaaagtgtgccccaaacaggaaaatgggggaacctgctgaggccacacttcttggtgggtcctgtttaacctggatctctcagcttcttaactctgtctctcaaattcactgttttctgctcctgcttccagagtttaaactcagtgacccaggggcaagatggcaatggaatatcctctgtctagcccagcaatgggatgttctttgtgtgctattggatttgggtgggggagggcatctgtagttatgttaagcagcctcaattttttatttagttatctgttgagttttatgatttcatcacacacagagagcaggaattgtttgaactttggcaactcccctcagtgtgtggcaaaccaggaccccctgggtagatggtggttgatgaagacggcaagtacaggtgcaggagtaagaatgcctgagcctgtgttatcttcaagttctcaaaggcttcagattggaattggtataaattaagttctcttagggaaaacattcgtacagtcattttgttacatacagggaaagaaggcaaggggaaaaggcagaaaggaaaatctgtaattcggattctctgatctgttggcattttcaagttcctaaggttcattggctagcctcatcagctatctattaaatattagggaatgggagtttaaaaaagtcaaaggcaccattcccatcaagcaatttgctttttattctcataggacacccatcctgtttgaaattttgtcctgaattaacaacaaatgtaaaggccttaaggtggcagtgcatcgaatgcaagacatgcagtgcctgtagagtccaaggcagaaatgctgtaagtatggctcccgtaatccgcctccaggtaactcgctaatttccagtgttaaggtgttttcatttttatagagtatggctactttctttctaaagctttaaatacacatgatgtcaaactgcaaccaggatcttggtgcactttccttatattgtattaatgttaatccagtaacaaaagaatttttggccttttacagttggtttcagtctcaattagtctctaatatgttatattacaggataatatgcttttttgtgattcctgtgatagaggatttcatatggaatgctgtgacccaccactttccagaatgccaaaaggtgaacttctaaactgtactaaaaatgtattttattacatattggttagctttgtcctgaggtctgacagctcagaggtatacaggttctttaagcatttttttcatccctcccaccttccctatacttctgagtttagcacaggttgtgaatagaggagtataaaagcatagaaaaaaatacatatatatatgtgtatatatatacatatatataaaataaaggctctaattcagacccagggatgaaaagaccatctctctctccaaaccattcccctattagaataagattagattattaaggtcaaaagtttagaacactttccatattattcagcacagtgttaagagcttaacaaattttatatttttgaggatgatagtgactccaaagtcctacaacaggaagccatcaccattttcttggccattagttgatattttgaacacgagcatctgaatgatcttatagctgattgtgtctgatggaatgtggattttcttctgtttattgtgtaaatcagctaagctcagccttttcccctcattttgcaatatattaaacatttaaaaataactttgcctttttattataaaatccataatttacattgtggaagatttaaaaagtacagatagacaaaaaaggaataaaaataaaaatgaattggaaatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttttagtgttggaactttccagaaagagatgataagacaatttttttttcttctagaaattccaaaaatggactgatttgaaaatgtctccctcaaatcaaaagatataatatctgacaggggcgagttttcatgtgtgtttatgtgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagagatctctagcgttcacctgacttggctgaattggtggtgccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaggggttttctgtaggctcttaacgctttatttttagtagcagccagttgggctaaatactcctgacagtttctaccttcagagctattgggtatttccaaccctcattctgccccgatctatcaggatgccttgtatcagctttcctttggctaagataaatgtcagatttcccccagttattaaggttggaagtccttgaaccagcccaggttggaaatggagcaggtcaaaactcctacgttgatcagtagtgggattgtgcccttgaatggccactttactccagcctggacaacacagcaggatgccacctcttttaaaaaaagattcgaagtccttaaatattatctttttttggcctacttctgacattcatatgtaaacatgaacagtaggccattatctgaaagatactgctaattctaaagttttttcattccaacatggtaaaactggctttttttattcaagaaatattcttgttctgtgtcaggcactgtaccagacaccagggataccacagtgaatctggcaggcagagttcttaacctcgtgtggcttactacatggaaataagggaaataagaggagacaaatgctaagctgcagatttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttagaacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatcccatctcaaaaaataaaaaataaaaaggagaaaataatggtatccaagtttttgtttgtcttgaactcaagattagcctgtgaacgaatatatcccaaaatgggtacattgagaatagatgtcttccataaagtatgtcagggtacactttactagtatcttcaaaaattttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggtaagcgcgtgtaaataaaaaaattcagctttttgaaatctagtactcctaattgttgactatgtgctgatttgtgtttagaaggtacaaagtatacttaattttggcactgaaattcagactgccctttaaaacatctccatgttttggaatgtttatctaaccatattaagcaaccatttagactgatgaagaatccctacttcatcacattaacatttttgtcttccccaaaatccctgtctacactagatatattcaccatgaatttatgatctcctcagctctttgtaaattctactttctttggcaggagaaatgagctttgttcagcagctccagccaatgtctggcaggtgctcactcttccagggaattgagcagctgtacatatctcctcaatacacaaccacctgtgtttccatccacttcttggcagtgtggataatccttttggtgagaccctagcagatgttgggactccctcccatctgggtagatggccacccctgaagaactctgctgttcacaggaaccccttgtggccatatgtctgtcattgtgggtttcttgaagacattttgtatttccagaattgatttcgtagcaggcctttgcctctatatagttgcattgtttaattatgtatctgttgtcagtttcagggattccgttaagctgagtcagtttcaccttgaggagaccatgcctttctcacaggttactgtctgtctgcagggcttttcacgtttctcctttatgctcttccctccacttgcacacttctgttgtctgctgcattttctcctctgtgacccattgtggtgtgcattggtgctcattcctaggtgcttgaaacaagcctaccttgtacagcaaacgtgatgtcctctttctctggaatatagtttcacttctggattttctttttctgaattgttcaggctgaaacttattattctgccttacagttctctttatttctggcctgcagtgtcttgccatcctattaaataaagggaaggttgtaggtttctcacatggaccaggctccttctcagacaggtctgggcccactagtttttccccaagactgatcagagaacatgggaaactccagttgtgtcttatgatttttttaaagctttctctttttctatcagctctttcggtaagcttggaggaagaagggtattgttgctgggaagattaggtgatatattagttcttactaaaagctaggcacttttgacatttcaagctggttagttctttgttgtaggggctatgctatacagcgtaggatgtttagcagcatctctggcctctgctaattggatgccagtagcaccaccaccccttccagttgtgccaaccaaaaatgtctccagacgtagccaaacatcccctgggggcgcagaatcacccccagtaagaaccagtgggctagaaggaaggctgaatgcacgttgcctgaccttcctgttggtatgctatcctgccagccccagccagctgaggtgacagagctgctcacagttgaagcttagctaatgtcacaagttcagctttcctattggctccttccttgatgccttagatcttttcttccaaccaaaacattgtttctcaaagctcaaaacacattgttggccttaagtaattatttcataaatcagcatgagtcagcactgggattgaagctctcataaatccatggaacgtcttctcatgggcaagggaatcagtcttgttaggatggtaagaatgggctgttctttcagggcaggtgcttttggaccatccagagatgagaggggagacatcagaagcatgtatgtaaaattcacttatacgaataaggagttggatttgataagtaccgaggtccctattctagaatctgagttaatagagtataacatttgggcaacttttctcctagcagtttcttacaaaacttataaaataaaggaggaataatcacacattacgattttctggccttccctttctttattcctcttacacttttcacaaccaatcagaattttcttcagcactgtcatctctgtatttttctggttcacagttatgtatatctccatctttcctttttgtaatatactaccatttccaaaagggccatactctcaaatacatgtaaacttcctttaattaaagggagaattgtatcctctgtgcccattgcccatatttgattgtgttgctatgtatgggacctaggttccatccgagggaaatagttatatgaaatctaaaaataatttgtgcaagatgagaacccgtatggtccacaggagacctgagaatggtcaagttcattgtttcagagctctggttagcaaatatccatttcccttaagaaaagtgctagggaaattcttcttgaatctgctgtgttttctattttcaaagagtaactacatttgatcaaagaaattggcatctgtgcctagcctcctgtctatagccatcagtatcacagcttgattcttttattttgaagagaagtagactgtaatcatagtgcttattgtaggttgaaattcatatcactttctctgtaagtattcccaacatagatattttatcttttccaattatatttaagatgatgcttgggataaaaccaaaatggaaacctctttgctaatccacacttctgaggaatcagaataatacagttcatttattttagttttatgtgaaacccttttgaaacaacataaagtttaacttacttgagaagtattttgatctgtttatatttccttaatacagatttattcggttcagatagagaggacatgcctgatcatttttagctcagaataaattacaagtaaaaattactcctttactagtggtttggcccttctttggtagcttaaagagaaattttaactaccttaaatgtaccctaatttaagagaaaatgtggaattctgatttgccagtgacagctgttttctggttaaagctgtacttgcttaatagagtgttttaatctctcagtttaggatttggaaataaaatgatgtactttctgaaataccatatagaagaaacaattttatatggtgcagtatttttatgttaaataatgttgtctgtttctttttgctaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggtaaaacaagagccagcatgaccttcattttctttttcaaaatgtttttggtagagcccaattctttgaacagggctttttcattactataatttgaataagtgacatgtgtttttgaaaagctcaggttcttgttcagagctcattttaaaagatgaaaacaaaaaacatggtgcctagtaagtgtgtaaaggacctcagcactgtgtgccgccttgatgacactctaattgctgccttgtggaccacttagcgtctttgattttctcagtgtttagcttatttccgttttccctttaagtggtgtcaacatgaaggtttcagtttagtgtagcatttaagagagaattctcctttctccttgttgccttccctctgtggtcaacagtatctcagtgagttaggacgctggcatttggacagtcaagctgataaaatgactggttttacacttttgtctcttattctctgtgctatggttttaagttctaaagcaatctcacctttagaaagcctaagtatcagccgggctcagtggcttacgcgtgtaatcccaggactttgggaggccggggtgggcggatcatgaggtcgagagatagagaccatcctggccaacatggtgaaaccccatctctactaaaaatgcaagaaattagctgggcctggtggtgcacgcctgtagtcccagctacttgggaggctgaggcaggagaattgcttgaacctgggaggtggaggttgcagtgagccgagatcgcgccactgcactccagcctggcaacagagggagactccatctcaaaaacaaaacaaaacaaaacaaaacaagaacaaagaaagcctaagtatctctggctgttagagtggggaaaacaatcgacatattgaggggacggatatagcttgtcctttttactggttcagagcagttcactcacattcttctgctcaaaggcttctaagaaacaataactcctttgcaataaaggaaaactgagtttggagatgtttaccaggtaatgaccttaacttttctgaggtacctaggaaatagttaaatgtaccaggatggtacataaatagagacaataattatgagacttttagatagaaggtccaaactctcttatttatgatatttttttatattaggtgatacatgaattttaatgaatctgctcttgcacaatgtaaatgggatgctttatagaagtgccattttaatgaagtttcaaaagatagaatatatgtgaaggtacttgcaaactatagctatcctaaatttaagaatcaacccaaagatcataaacaaaaataagtaacagcattcatggaaaactgtctcagtgttttaatccacatatttggtaaagctttaaaatgaaaaagaagaaagttaatttgcacattacaaattcaaaagatgatagagaattaacactgaataaaacaataaataggaaatctatatgattaataaataaaacaccttaccttttatgtaggtttgtcaagatcattcttctccagaaacttaaaaagaatagtggttgcgtccttgctgttagaaaatggtgtttctttcattgtctgtggatttaaacataggcttaacggtgcccaccttcctcgtgctgcactgaccatcccactcctgggtcttgtgttggctgctgagtagcagccatgtgtagagttggtggtgattcttgaagtttgaatttctgcctctcttcctgccagggtacccaaaattttactcagaactagctcaacttttctcatagtttcttctatagcatggcagcagctgctgttatttcctactattctggaatactaatatgccttggcagtatagtgaaacaaaaattaatctaaaaaataagcatgttaaaagactagatgaggccgggtgcggtggctcacgcctgtaatcccagcactttgggaggccgaggtgggcagatcatgaggtcaagagatcgagagaccatcctggccaacatggtgaaaccccgtctgtactaagaatacaaaaattagctgggcattgtggcaccctgtaatcccagctactctggaggccgagacaggagaatcccttgaacccaggaggcggaggttgcagtgagctgagattgcaccactgcactccagcctggcaacagcaagactccatctcaaaaaaaaaaagactagatgaaactaaaccatattctcatgtgtcagctggaatctagaggactctggccctttggggctattcttgaaccacattctagaggttattagaactacagttcaaggatagccagagaagggctggaatgacctggaaaggttcagtgcaaattgttacatgcatatgactttccaagcacataatagatggctgtaaacagaaaggaaagaaggattagttattttattcatagcttagaatttagctgtagtaacatgttaagctgcacggaggggaagaaggatcactactatgttggatctcaaaaaactccgaaaggtggaaatggttctggacaaagcaaggaatggtatcaaggatgaattctcttaacccagagtacatttctttttagagagagtgacccatttgtctaactttgcaaaacagacgaattacttgaacctttgccattgatgtgcacatccagtgagggacaattcatcttcttagaaaaactgacacacattgcttcatcctcattttttagaggctccatagacaactacaaatgtgcaaaagttgggagtacatctttttcacaaagaaatcttcaattctgccctgtagggttttttccacaaccatctcctgtgatctttcaaattggttcattaaagatctgggtgttctgaagtaattctttggtgtggtctgtaccatttgtggtcagtcttatttgtggtttatatttggccagagcatccacgacctcaaaagccttttccagatctctgtgtaggttttggcaacttctttgtactctgaataaaaaaatactgccctgatgccacatcccatgaaagttgcaaattcttctttaactgtaagagctgtttcttaccatgttctacccagtcttcctcctggtttcaaactgttcgtaatattttggtctaacctttgtttggaggctttagggtttcttgttgttgtctttttgtttcattttattttgttttcctggtttgaaatgcagattatttctctagctttttacattgactttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagccattaccctgaatgaaccgacagaattacattccattttgtggtgctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttctaggcagcttatcctgggccttgctagtagaaataactcttaccttattttgttaatttcccttttctattatggaaattaatacagtgtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaaagtctgtcgctaggaaccaggtgcttcttgattaccagattgcagtttatctgattattaactgaaaggaggaaaatttaggactttgcacaatcttcatcagctacatcagatgcaaaaaccacaatgtaaatgcgcttacagaaaaccatgaagaaatatagtgaatctaaatctatattgttaggtattaaaagattaaggtctgattaaagtgtaaaataactgaatagcagttttggactgatttatatgatttattgacattgaagaatatgattcttttaaaagaagaattttgattatttttctctttttagataatatttttagttatttattaattaccctagtcttatctatactttcctgacctaattatccatgaaaccagtaatcccaaggagggccaccttaccaaatgcagtgtaccatttttatttttatagagtcctagctgtaatcatttctgagggcaaaaccatttatcttgttctctagttttgtgtggctaccattcataagtagttcataaatatagtttctggtatgcatagcagccattcaagccttaaatgtttggtcatatctatatgcctacagaataaggcaaactccttagctcaatatttaacgtcttccaacatctagttccagcctgtcctttaggctttttcatctactaatctcctttttctcaaatagtctgagcatggtcctatacctctatttttttgtctattcagtcccttccttgaaatgatcacctcgtcctttcctagactccgtctgttcaaaatcctgcccattgttaagagccagctcaagaatctctgctttttgatcccacctcctggaattttatctcatacctttattttatcttataccatattctatatggtatcacacttacactctgttcacccttttatgataattattgatggaggtttcatacttccaacttctctgtatccactaggacagtttcctttataataatatgtattagatgatataaattaaattttattgatataaactaaatttccaaattgatatatggttgctgtccacaatcattgtctacctaaaattaaaaaggaactggtacttactaggtaaaagttcaagctctaaattcagtagtatcttatttgtacagcatgatctggcactaaggccttctacataagagaacaatctgggtaacaaatacattatcttcaaatgctatgtcttttttttaaccattttagtgaaaactgttactagaaactaccttgtattattaaactacagaacacattgaaaccttttctcagtggctccaggccaccatgatgaatgctgtccaccaggatgtgagcaggcaaagtagtgctgagggtgtggtttttttcttttctctttcctgtacacctagcattgcccctactggagtgagttaagaagtgcagtgaaagatttgaataaagttgaagagactggtgttattccctcagagaaggggaaactaggggaagaattttatagcactcaaagaaaatgggaactggtgtaaacccaatagaaattcagtttaaaaccaaaagaatttcttggctataaaagttttaaggaagatagagtaggctgctgaagaaattaatagcaccttctcttggaagttacttaaagtaatagtagataaatatctttccaaaatgattgaaatccagcctttgaaggtagggatgagtcacatgacctctcatgatcatttttgatctcataatttggagcccaggatagaaagctaactagggttacaggttttctaaaatctgctctggttttttaaaggactttttaatggttaaatttattttatttctatttggtaaatgagcctggggccttttggtcagggatgtattttcagtaagtcaaatgaggttgtaaatcaggtagatctttataattgccagtttagtaagctgaaacacgatacgagcagggagaaagatatagccgcccacttgcacacttgatcacagacatgggtggaatgtgatgcactgtgtgtatatacatgctcctagacttacagtggggctgtgggctgataaacccatcataaagtgaaaatatcataaattaaaaatacatttaatacacctaatctaccaaccatcatagcttagcctggactttaaatgtgctcagaacacttacattaccctacagttgggcagaatcatccaacacaaagccaattctataataaagtgttgaatatctcatgtaagagtgttgtaccacatatcgctagcccaggaaacgatcaagtatggtttttactgatcataccatagtaaagttgaaccaagttgtaagttgtaagttgaaccagttgtaagccaaggactgtctgtataaagaactgcaaatgcagggctttgaacactgttcttcagggcagcagagtgaggtggaatggtcatccatgggaccatgtgctgcttgcagagtaagtcatttgtatatcacttcctagaccagcttctctgggatttgtcagagcaaggctccccaggaggccatttgcagagtttggccagagtgagtaaagggcaccaactcccaatctggttataaactccctagtgggttttatgactctttgcccacaattggaatgggtggaggagagagtgactatcgtggattggttgagaacgcattccttcctcttggattctaggattccctttctcagtcagaaaatttgaaagtcttccccatctctgtctgtaaagtctttctatctctctctccctccgtccccaccagacatctcagaacttcagagaactcccttgcccacaaaacatttgcagttcctacttcagagcctcacaccgtcaaggcaaggagctcttcttctcccagccactgctgagcactgggggcccagagtgctccctcccaagccctggactgcttctgctgctggggctgcccagcaatgccttatccatctcactatttttttctttaattttgaaataatttcagacttagagaaaagctctaagaataataccaaaatttcccgtacattgttgcacatgttcacattttatcacatctgttttctgctctattattctcaatctctccctttgtttctcttctctctcatattttcttttcagaatcatttgagagtaagttgaagatgtgttgcacctttacccctaaatattgcagtttttctacaaagatgctctcatatatagccacaatacaaattattaaaatcaagatattaaagtaatttatgcacatttgttcaaattttaaattttgcgagattatactgatgttctttctggaggaaaagaaaaatctcctactccaggatcacatggagtatgtaattatgtccctggggcctcctttaatctggaatagtacctgcttttttgttttgttttgctttgcttcgtgttttccatgattttgatattttttaagcatacaggccatttattttgtatggtgtgcctcaatttgggcttatctgatgtttcctcatgattagatttaggctgtacattttttggcaggaataccatagaagtgaccgtatgtccttcccagtgcatttcatcaggatcatatgataatacatttgtctcatcactgggttaaggtggtaactgccaggcttcttcactgtgaaattaccatttttcgctttgtaatcagtaagcatctggtgagaagatactttgggattatataaatatcaattctcatccaattttcacctcctagttttaccattcacttatggctcttatctaaaataattattactatgataattaccaaatggtaattttctaattccattctttctacaacttactaattggcattctagaaggaagaattatttcttcttccccatttatttaatttttttgtataattgtgggttttaattttattctataggttataacctgtcattaccatgattgattttgatgttccccaaacatcaaattgtcccagatttatttatcagcaaatgtttcaagtgggttcttgtgccttttccacatgcttccatcctgtggattcttccttcctttctgccacagcatgatgttccaggtttagcttatccttttcttaagccagccctggaatcatccatttctcccaagccttggttccttatggtggagaacagtagttaggaaccaggatctgggctgggtgaggtggctcatgcctgtaatcccagcactttgggaggccgagacaggcggatctcttgaggccaggagttcaagaccagcctggccaacacggtgaaaccctgtctctacaaaaaaaaaacacaaaaatgagccgggcttggtggcaggcgcctgtagtcccagctacttgggaggctgaggcagagaattgcttgaacccgggaggtggaggttgcagtgagctgagattgcaccgagctgagattgcaccactgcactccagtctgggtgaaaaagcaagacttcatctgttaaaaaaaaaaaaaaaaatggaggaaaccaagttctgatcacttaaatgtgcccattgctgcttgggtgtcactgcttctagccctctcagaggacagagctaggatagcatgcatatttatatccatgtatgtgcacatatacatatgggtgttataaacacatatgcgtgtacacacacactcccttcatgagttcagaccattccagatctgcgccaccatacggttgtattctgtctttccctcttcccatgtaattcctttctctgacagtgagaaccctgacttccattacccacaatatacttatgtgctacaccctagaatacacagtaagtagtttcagaattactaactcatgccattgtgaaaaacaaacctcttaagtggaggtcaatatttatatatggttccttttggctttaccccaagtgtatttagtcaaaacactgtgtttaaatgttactagagttagtttttctcccccttcagtgttactgtagtattcattggaatacaattaggcttatttgtttctgtttgttttttattttatacttgttacctttttaaattagaatgtaaaacattaacatgattttaaaaatggaaactgtattaaagggtattctcagtgaatgtgccctctctacccattcccattccctcatcctttcctgcaggtctccaatctcattagcttgtagtttatccttcctgtttctttgtgtacaaatgagcagatagatgtgcatttttctaatttctcctcctttctaacacaaaatgtagcatactataggtagtcttttgcattttgatttttccagtatatcctggaaatgacttcatagagatttcttttctttgacagctgcactctactccgttgcatgcatgtatacagtttgcttacctgctttcctatgtatgggtttataggttgtttccaatattttgcagtttaaaaagtagtgtcatgagtaatcttgggcatattttgactgatagatacttaggtagcagttattgtatattagatatcctttcagttgttaggactctgtttggctaggtaataagtgagcagataatgaattgtcttttactcgggcctgcagagccagaaccctggctgatgggcaggatacaaaacccgttctcctgggctctgacccaggagagaccgagggaacaccaactgattcagcagtaggtgagagaaccaagtgccagatggtggtgagggaggtggcaccatcactcacatgtgtgtttgtgtatatgcatttatctgatgccaaactggaggataaaggaagatgcgaagagtcatgtccttcattttttacctctttactttaaccttattgattgggataccacactctacattctgctaaacatcagcaaccaaaagggaagaagacatagctcttgctgggctgtcaagttcactgacaaatcaacaaatgttgcatagtattttggacagtatgccttgagagctcataagaagttgaaatgaaaacattctaggcagaggggagcagcatattcacaagcatgactgcgtgaggaagcatgttacatacctgggtaactacagcagaaactccaggtagattaaagacttgattaccaaaaaacagacacacagaaacacttaaaaagctagaggagaggtggggtgcggtggctcacgcctgtaatcccagcactgtgggaggccgaggcaggcagatcacgaggtcaggagatcgagaccatcctggctaacatggtgaaaccccgtctctactaaaaatgcaaaaattagctgggtgtggtggcacacacctgtagtcccagctactcgggaggctgaggcaggagaatcacttgaacctgggaggcggagcttgcagtgagctgagatcgcaccactgcactccagcctgggcgacagagcgagactcggtctcaaaaaaaaaaaaaaaaaaaaagctagaggagagattatgtataattatttatctgatctttggatggtcaaggacatcataaccatcaaagcaatgaaagaatatgcagatagacttgactatataaaaatatagaacttctatctagtaaaaagtattaatatttaaagcaaacataatgagaaagatgtttgatgtttacaacatatgtgctaggcaaagtttaatatctatagtgtttaaataaatatatatatacttttaagtttggtagcattaaaacaaaaaccctaatagagaaatgggcagaggatcagctatggtggctcatacctgtaatcccagcactctggcaggccgagacaggagactcacttgagcccaggagttcaacaccagcctgggcaacacaaggagaccatctctctctctttctctctctctctctccccctgttctccccacccccccattcccctccttctctcgtctctcaataaatacataaacaaataggcagaggacaggaacacagaatgtacagaaaaggaaaatcactggtggccacgacattgctgacatttactgagtgagtaacatgtgccaacccctttcctaagagtcctgcatttattgattgattcattcagtcctcacggcaacagttgagatatgtgcttttagccccattctatgggtgttgaaattgaggcacagttacacaaataagttgcacagctgcaaattgaacccaagcactttaactgttagccactccactccgaagtctcttaggtataatggctaattcaaatatgaaaaaaaaattgttggtggtttaaaaatgcaaatttagtaactgcaagattacaattttttgcctaccacactaacaaagagtttacaacttacccaaatctaactaagctggtggaaaatggacaccttatttacactgaagaaagtgtatattggtaggcattttctggaactttgacagtgtgtatcaaaaacatctaatggtttttttttttaataaaattttatgtatttaaaaactaggctggggacagtggctcacgcctgtaatcccagcactttgggaagccaaggcaagcagatcacctgaggtcaggagttcgagaccagcctggccaacatgacgaaaccctgtctctactaaaaatacagaaaatagccgggcgtggtgatgggtgcctgtaatcccagctactcgggaggctaaggcaggagaatcacttgaacctgagcggcggaggttgcagtgagctgagattgtgccattgcactccaaccaggtgacagagtgagactccatctcaaaaagtaatacataaaacaaaaaatagagacagggtcttgctatgttgcccaggctggtctcaaattatggagctcaagcatttctcctgccttggcctcccaagtgtgggattcaggtgtgagccaccgtgcccagcctccaatggttattttctaaaggaattcattctagggaaatcagcatattttaatcaacaaacattattttcatagttaatatagcaacattattttgtttcatattattatgttttaaatagtggacttctctttttgcctccctcccccagcccctgattatagcaatatggactcatagtagaaagttaaaaaaaaaggtgtaattaatagaagaaaatgtcacccagagagttaatgttttggtatatttgtccttcacactcattatttacaacaggtaaaaaactaaaacagacttgatatttcaaaggcaagagagaaccattcccacgagaaagttatggcacatccatataatggaatattattagctgctgagaattatgttctgaccaggtgcagtggctcatgcctgtaatctttgggagactgaggcaggaggatcacatgagcccaggagttcgaggccagcctgggcaacatagtaagaccccatctctacaaaaataaataaatgaaattagctgggcctggtagcttgtgactgtaattccagttactcaggaggctgagtcctccattaaggatggcttgatcccaggaggtcaaggcttcagtgaactatgattgcaccactgcactccaacctgggcaatagaaccagaccctgtttcttaaaaaaaattatctgggaatttgtaatgcttgtgataagcaagtggctttcaaaattatatatgtaatatgttctcaattatgtaaaaaatatgcaaagcaaaacaaatacatttctagatgacctctggaattagaattacagatactttttattttcttatttatactttttgctgtaactaaaaagaaaagaggccagagtcaatggaggcctgacagtgaggatgcatggaaaagaggcaggtcctgttcgttccgtagcaggagcatgcctggtgcagagtggtgctcagaaaatactggtatttattgaatgcataactgagcttggagagatagtgagcgcagctttatgtagctttcactgtgcgtttggatgtctacgtgcactttgcacagactccagagctcagcagggggtctgcattagagggagcagctgggagtcgtggacatgcggtggtagctgaaaccatggatgtgggtgagggcaaccagggggaagtgtatagggaaacagggctgagggtggagtgcttggagtgttaacatctaagggactaataaagaatgaggagctcgccaaggaaatttgcaaagggcccagaagtcagaagaaaattgggagataatggtgttaggaaaaccagaagaggtcagtatttcaacagtaacagtcacaataatcatcatagctgccacttctagagcccttgctatgtgtcaggcactgttaccggaattacacacatttactcacttagtcctcacggagaccctatggggtaggttactgtgaccatctctcttctgggacgagacactaagagacttgtctaagatcatcccccagagattcagtgccccagagagaaagtcataagaagtattctttggacaactgtatattaagtgcgattaaaagtagattcaaaaagcttttgactgttttattctgtttggttgggcgtagcgtctcacgcctgtaatcccagcactttgggagtctgaggtaggtggaccacttgaggtcaggagttcaagaccagcctggccaacatggtgaaaccccatttctactaaaaatacaaaaatatggatgtggtggcatgtgcctgtagtcccagctactcaagaggctgagataggagaatcacttgaacctgggaagcagaggttgcagtgagctgagatcaccccactgcactccagcctgggcgacagagcaagactctgtctttttttttttttctttttttaaaacaaagcaaaacaaaacaaaacaaaagcttgactgtcaagggctggggacacaggaacctagttgtctttatttttaagctggagagcctggagcatgtgtatgtacatcagtagggaaaagaaagagcagcgctgatggaaaaaatcgaggggaaaacaaaaagcaacatccaggcaggtggtttattacaaagtctgatctggcatttgatgaaattcaacattctctcctaactaaaatacttaaacctactaactagaactataagggttctaaatctcagattaactttttcttttttatcgggggcagacggacgtgtaactaacgctataaagggtaaaggacagctggatccaagtctacagacttacgtctatagtttttagagaccagataaacttgccattaatattaattaatggcaagttcgtcagttaagttaaatatcagttaattgtacattcaggcatttctaaaattagtatgtttgtggaataatcataaaaatgtgtcagcagtttcaatttttggctttctttattcagtattaaaatattgggcagtccttcatggaacaaggctgtaactataggaagcagaagtgattgaatgaattaggcattcacttcggggaattccctttgctggctcttcatatgttgagggtttcaccttagcttttgtgaggtccgtgtgctatttaaaaactgagtctataattaatcagcgctgctagaagatggtgcaaatggcccagttttgtgcctccaggttatgaatttggctcttgtcttcagtgtggtttgcagcgtccttctacatgtccccttttttagaaatgatactcccctccacccctgccccccacacacatatacagccaaccggatttaaggaaagcaggaactacaataaacttttgaggaaagatgctttagggtatgatttagtaccttagttcctttctcacttgagtattaatcagtgtggttttctgcaccgtcgttctttcctcctctggtttaatgacagagatttcttctttaggtgccacaaccacccacgtccgtagagatccccgggcttgtttctcctttagcctctgaatagttcttggctgatttcttgaggaagcaccgcattggaagagaaaagcatcttctctttggtttcctgctccctgcttctctgcccttttaagtccataaagcgaattaggaagaaagccacatacttcatttctacccaggggggtatcatgtcaggaggctaatcatatccactctctcagagagaaagctgcttcttcccagaatcttagatgcaagctactggtttaaatgttgtattatatgatggctaaatacagaagtacgtgtcatagtagttcaggttgccagctactactagttttcacagtctgccttcagtgggctattttgtttaaaagagcttccacttacaagcttttcaaaatacaatttaagtgaaacttaagagtgtttttaagtagagactaagtggtttcatcctacctgaaaattgccttcttgaaataaatgtttgatacccactggcctatctcctctggaaaacaggagttttcatttagaagtccagttggttggattccagtaagccgtttcacctgactgtattacgccccctggaaccagggctgtgcaggagccaccggcttctcccagagggcagggtgagcacagtatcagggcacatggcttaccctcaggagctgcatcccagcctcaaggccctggtgagaaactgtgctctccagcaagggtctctggccgtctctgcaccgtgtggtcagcttagggctgtgcctcccaagacaggacctgaggatgggtatgggtagcagagatattgctccctttgctcctgggtgtccagagctccagtgcctgtcacctcacctctagcagcctcaggagctgtgtaaattctgtcatatacatgatgagggagatcatgaagcactcacttgaatcataaagtctgtctgggggaggctgcagagtaaatattccactttccccacttacaggccccacaaacaagcctcagaaatgtgtttggagggaccatgacagcatctcttagggacttgtgttatttagttttctctctctctctctttttagtggcactaaccaaaaaaaaaaaacaacaacaaactaggctaagcaagtgcagagtcatttataaacttgcataggtcttttatatacagtcatttatcatttaaaaactgagattcattttgagaaatgcaccattaggcaacttcattgtcgtgtgaacatcatagtgtatgtacttagacagacctaagtcgaagtctataggttactacacacctaggctatgtggcatagctgattgctcctaggtgaccaacctggacagcagttactgtactggataccgtaggtgttagtggttgtaacataatggtatttttgtatctaaacatatctaaatatagaaaaggtacagtaaaaatatgctgttataatcttatgggactaccattgaatatgtggtccatcgttgacctaaacatcattatgtggtgcatgactgtatttattgttgattgcccatgtctttcaccaaaagtaagcttcatgagagtgtggactttgctctttgctgcattctgatcttctagaagagcctggcgcttagtaggttcttattaattgttgaacaaatgttaaattaattatgacgggaagaacttttaaaatgtgctttcccttctagtgtgtgattcttagggacaattttattttattagaacataaaccatcagcactggtttacttacttccaaatgatgctaggtatgccctgtcttctttcgaggtctggtacttttgctgaaatgcagcctctatcttaagatcatttcagttgcatcagaaagaagatgtcactgcctgctctaaaccttgggcggagaaagcagagctgtgacataatccacatttgtacatagcaggttgaagagacacttaaatcttttgcttactttttctcttatcagataattcatttcttgattgcatttatttttgaaaggaaaataccagctttagccataagaagctgtcaagaaagcttctctttgcttagccttcccagcagctacgctcctgggtgagtgcagtcaaggcaatcattaaagaataataagttatgcttttgaaatggtgctcaagtacttcatagccttttctaagataaggagcctcccacctttgcccccatgacacttgttggaaaatactggaccagcagctatatccttgggcttttgctgggttttggaagacacattttgacctatgtaatcaagtataatgatgacatttattttaataggattctagtctgtaatataataaggaaaatggctatttttccttattttctcattataatatgttacactaaaagcttctgccattactgttttattatattggtctgaggtacaatatattttaatatgctaaagataacatcaaggttgaaaattgagctctcagtgatttattcagaggttgactgttgctgaatgcattgaaatgagttgcatgagacagtgcggctaacgatttatttgtgtatctttttttaagctaagcttgtcataaataagagcaaataaatagctcttatagaatagtttgtattcattgcctcaatgaaaacattgtaaatatgaaacatacggtctgcagtctctctcattttttctgaaagctagtgttttgccttacatagctcagaattttttcaagttttggcatgcaggtggttggttttttttttttaccaaacaaattttttgtctgtttggatttctaacgttgactggcatttgcattgagttattttgaaatccactactggacaaattccattcaaataattggtatgagaataacctaatcttcagcagaactggaacaaaatgaaaccttagtgggaccatcaagagggcaggaacttggtcattgctaaactccaagccatgagcacagtgcctagcacatagaggatacagaataaaggattgttgggggaaatcaatgaatgcctgagtctagttaatccacttctttgtatgactgtcaacacctgccagatgcatccagctagcttttgaccagtagtgcttaaactcagatctcctctcagtctttgttttttacactttatttatcccttcatcccatccttcagcaaacatgctttaaatacactgtgccagggatggtctaggtgatgaggacataaggatgaatgatttagtccttgcccatagggaagtagagggtcagacacaaaattcttcccagtcctgcaatttcaaatttcagagaggctgtggcagtgcagaggaggaaatgcttccaactctattttccatttacccagttaagatatatagaagagacgcatttttccttgcttttctttttaaagactgggtctcactctgtcacccaggctggagtacagtggcgtgatcatagctcactgcagcattgaattcctgagctaaagtgatcctcccatgtcagcctcccaagtagctgggattacaggcacatgccaccattcctggccatttttcagggggaggggtggggggtcagctagagacaggctcttgctttgttgcccaggctggtttccaactcctggcttcaagttatgctcctgcctcggcctcccaaggcactgggattacaggtgtgagccactatgccctgagctgttgttaaaacaagatcaagaaagattttgctctgcttggttgaaattagtgctatacctcatttgggtttcaagagaactattcccccttgaacatatattccagcttgtaatagagacattatgtttgagatagaatattctaagataaaagtttgcttccacttacccctctcatgatggcatttcgtttttttgttctttttttttttttcttttgagaccgagtcttgctctgttgcccaggctgaagtgcagtggcacgatctcagctcactgcagcctctgcctcccgggttcaagcagttctcctgcctcagtctcctgagtagctgggatcacaggcacgtgccaccatgcccgggtaatttttgtatttttagtagagacagggttttgccatgttgcccaggctggtctcaaactcctgaatacaagcgatccacccacctcagcctcccaaagtgctgggattacaggcatgagccaccacgcctggccctaaacaacacaactataacttcagctggttgtaaggtagttttttggttggttggttggttggttgttggttttttgtttgtttgtttttaaatataatttcatattgggtaaaacaaaaggttttccttaacttgtttagaattgtttaggaaaatactagttaggaatctgattttttttctcccccatggatttgtggttagcatgtttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcggacgtcagtctccacaataaatttgcatatgtccttttttgggggcaaatacagtcatcattttaaatgaagtcgaagagttatttctgtaaacaaaacaaaagtcctccttgtcatactagacagcaaggaagcaaaaattgttagggtcatgtcaaaaagactcaggagtcaatttgaagaggttctgaccagacaataaatataataataaagataaaaaattgcaatttattgcaacttgtcaaatgtttaaattcacaagttcataatgatactaaaaaacaaactgatttagaggataataggaaccagtttattttcttgaaagctgcaaaaattgcaattaaaacatttatcctgcctttcttacataaactgtacagtgaagtaatcaagtagtaaaggaggggaaacatcattttattttttaaatttttaaaaattttttgagacagggtcttgctctatcacccaggctgtagtgcagtggtgcgatctcagcttactgcagcctcacctcctagactcaagagatcctcccacctcagcctcctgagtaactgggacttcaggtaaacaccaccatgcccagctgattttttcattttctgtagtctctttatgttgtccaggctggtcttgaactcctgcgctcaagcgatccatctgccttggcttcccaacgtgataggattacaggcatgagccactgcacctggccagaaacatctttttataaacatattccagctaaccaatgaaaataaaatgtacggtggctcacacctgtaatcccagcactttgggaggccgaggcaggcggattgcctgagctcagggagttcacgaccagcctggacaacatggtgaaactccatctctactaaaatacaaaaaattatccgggtgttgcggcatgcacctgtagtcccagctacttgggaggctgaggcaggagcatcccttgaacccgggaggcggaggttgcagtgagctgagatcgtgccactgtactccagcctgggcaacagagtgagactccatctcaaaaaaaaaaaaaaaagaaaagaaaatgacagaattaaaatataaccattttgtaatccccaccaccaccatgaattaatggatctagacaatgaacaacatcaacagttgcaaaaaggacaaccagaaattatctatcttctgatcaaggatatttgtagtcttgccagtggatggaacccaagtctaatcaatcaagcactggatctagttaccattttgcaagagatacagagtaaagaggagcatactgagctgcagtgcaagtaggagatcagcaaaatccagagtgaggacagtataggtcaagtggccccagttcaaccacagatagattacaaggaaaagaaaggggtgaaggtggaacccctagattaaaatgacattaagatttttttttttaataggcaagactgttctagtgcctggactgttttggtgatgaaagtataaaaaaatgcaagagattattgtgaaagtcaggatagtggttacttatgagagagaaaggagaggtgattggctggagcggatagaaagttttctggagtagccggcaaacttctatttcttgatcctgggtgatagttacaaggacagttgccttataataatccattaagctgtgtatttgttttttgtcattttatgtatctctgttttatttttgttttttagaaagcaatcatcttaaaatgggaggtgacatcctatggtatcttagtgcttgggtttttgtaactcttgaaactgaaaacttactcgatttattggtggcatcctactagtcatgttttaaagagagacacagttttcaccttgactgcttgaaaatgaaaacttgagtgcacaagtatttagtgtacgggcatcaactccatgtcagcctttgcagagccatttttatgtgaaggaaatgtactgaaatttacttgaatcaaatcctctgaagtgttgagtctagttcattagagaacagcattcctgtaaatttcactttcactcttaaacttagaaaaacataattgaagggttgtgcgttaacagaatgaggatgaaatggaggattcggacaaggaatggtgatgcagagtgaggatggagtacagagaaaatatttaactgtgagcccgaggagagaaagaagagacactgcagcatgagaactgttttcccatttttctttttttgtgggaagaacagcaccagcagacactgtaagatgtgtacaggaaaattgctctttcctcctcctaggttgctgagcagttctaaaatttgtggtagatctttaggcactagaaacagaacttagagaaaagatgttaaaagttagatttttaagaaagggaagaaaaaggctacgatgacttaaaatgtcctgaaatgaggctctgctatttatcagaaaaacaggcttccttcttcttaagaaggtgattgtctgttcatagactaggagtcctgccctggggttcacccagcgttggagcttttctccatgaagttaaggacattaataagatttttctctaccaaagcagaagatgctctgaagacagcctttcatccctgtagcttttgagttgcatccagttaaaaacttgtagaacataatgaatgtttttagagaggaaataaaatgaatgatgcccgtgaatttgttttaaacattgtttattttacctaataatttatataaatcttccttgaagaggaagagaaattaccagatttaattaataattggaagctttttagaggatttactttgaaatacctccctgccaatttttcataaattaagcataaactttctttgacctcatcacacataattaaatagctgtggaagggttaaaaccaactaaaaagcaattctgtatctcaatctccattctcctgcaaaacttatacaggaagtttgtttcagttctcaagcagggtaattacaagagacagttacataatttacacttccaatctacttgtctataatcacacacttctacctagttgtatatacccccatgagtatgtgtgttgtactttgatttgtaaatgatgattgcagtgtgattgattccttgcaatgtagcatattgaattcattttttaaaaatgaactttagctgttaacatgtctatttgagttcctgttatttacgtagtttgtggttcttgtgttcagcagttgcataccagctaacaaattaaactcccagagctttttttctcattaaatttggaaaatagagtgtctgtatacaacctaaatagaaaagtacctagtacctagtaggcactcaactgttggacatagcacaaaaccatttcaagcctttgcaggtggaatggagattctttgattaacataatataaagtctcatggggataatattagtatattgtggtgaagctctgctaatattaatgtattgttactgaagtctaaaatttagccaaacagtggacagaatagcggttcattccaggggcttagagaaatgtgtcatctacaacctaagaggtagtcattgctgtctttaatgctgctggtgacgatactgcatatgtgtttgtttttctaacagctaacatctactgtagccagtttggactttaagattccctaagattaaaggctaagtccctggccgggcgcagtggctcatgcctgtaatctcagcactttgggaggctggggcaggcagatcacctgaggtcaggagttcgagaccagcctaacatgaagcaacccgatctctactaaaaatacaaaattacccaggcgtggtggtgcatgcctgtaatcccagctactcgggaggctgaggcaggagaatcacttgaacccgggagatggtggttgcaatgagccgagatcatgccattgcactccagcctgggcaacaagagtgaaactccatctcaaattaaaaaagctaagtccctacatgacaccaagtccatgggcaaaccagccagtcacttgtctggcccccctcccaccctagctccgctacccagggtgcctttgtgctgcacagcttcagagggggctcagcaataaccctggggggacacaaccattgatctccagaggcttcttacctcaaatcacgtttcaaagcatttgggagataaataaaaaataagcgaaaagaaaagtagaccagtggagtgggattgtttgtctagataacctgaggacaactagcgacagtttctcttacatttccaacagtggttgatcagtcagattaggtgatgggctgtactttgattttagaaagttatctccaaaactgacagattcctttttgaaatgtactttgtttgaaaacaaagaaaatttctaaggagatttgtattctcattttttctttcttcaatcttgctgtgtatttttgtttgctgtgtgaaagctcatcatccagaattggaattacaacatactttgtcctatttttaaaaattacagctggtacatacacacaacactcccttccacatatacacacagcattttagggggcttgtaggagagcaaatggaaaggcaagttgctattccaaccatcctgtctcccaaacctggttctgaaatcagtggtactgccatgattatgtaaatagcacccctctcccaccctccaccatcggtctgtggggttggaccagaccagatgactagatattagaatgaagtgtctcagctgcctcagtagaacctcagacctataaaagtaggcaaaagaagtctcagtttttgcatttagtgatttagttaaggaaaatgttcaatcgcagtgttttcgcagcaggagaacaatcttaaaggtaaagcattttaagtgcatgcagtcatttgtttggcgcagatgctttatttaaagtgtatatgtgttcgattaagtttgccatcttaaagcctttcagtggtaagttcttgttaccagaattttgtaacttagacatgaaaattttatccaagtttcaacttggggagcaagcctagggggagccaggtatttaaaatgctttcttttagtgaaaactgaagaattaagttgtcttctatttcaattgtgttattttctatttcaaaaactatttctttttttaatgaatctctaatgtagacttttgcctatttataagagaggaaataattttaaaatgccaaattacttcatctttaaatttttaaaaataaatgtgtttttcctaaaatatcctagaatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcaatgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcctcagttgaatgtttaatgaaatgaaactctgtgaagtgtatcacacagttgtttacggagtggccatcctcccctgcgtcagttcagagatttgcctgctgctgggatttctcattaggcaccactgctaccactatagccctgtgaggtggcaaaaatgaagaagtggtgctgtaccccatttaatattctggcccaagtatagtcccccaaggccctttccttactgggacccataatatatctgaaaccaggcaagtcatgaggttgggtggaacacagacatctgtggctttttaaagccccaagtgagtctgatgtgcaggcagggtcgagaaccactgggctatacttgaagacagaagaaggaacaataggccaggtgcaatggctcacacctgtaatcccagcactttgggaggccgaggcaggagggttgcttgagccgaggagtttgagaccagcctgggcaacatggtgaaaccccatctctacaaaaatacaaacattagccaagcatggtggtatgcacttgttgtcccagctactcgggaggctgaggtgggaggatttcttgagcccagaaagttgaggctgcagtgaaccaagatcacaccactgcactccagcctgggtgatagagtgagaccgtgtccaaaaaataaaagaaaaaggagcaattaattctctcactgggtaagagaatcaggtataaatgccatctcacacagatgtctctggccctcaggctgcttccatgtggcacgtgctatcctggcacctccggctcaggagcacatccacagaggtctacgcttctcaacacaggggcggtgcagagggagggaagtcccctttcgtgctgcctgatgccctacttgtgagttcattttctttctgagcacctgtacctttccctgggggactgacatgcagaatgaccaaccccgcaagggagtccacacctacccacagaaccatggaaccatctggtaaatcccagcatggtcagtcagctcagagacacaggcacaccacacggcatcggggagtcacactcctgccatacatcttccactgtgggagttgaaggaagaccattccactctggaatggacttgaaaggatggggacattcagtaagaaaaatcagtggccctttggggaagagctcagcagtggaggtctgctgaggaacttgtgggatcccagagaagagagatctaagagtggggcttagagtaacaggctggtatgtgacccagggcagccagcctccttccccaaagacatgctgtgtccatgctcagggtttcactgggtcaggccattttcccagagacacacttgagtcttgttgaatatttgagtctttcatctgtcttgggactgtccctgggctctgctgaagccctaagcagtcattgtttctgtggttggatgggctagccatttcctaagggtagtccttgaagttaaggactaaggggccaaagggaatttgggggcacagaactgtgtttgctgggaactttgttgccatttcttaagaccactcctgaggcagaattttttttcatagcctctttctttaattcaattgatatctgggtggttagctggggggaggggagaggaaggaagggtgggatgagaggagagcttctgtctgagttcatggaatggtttttaggttcctcaggcaaaagtaggaaaacaaagttagcttttctcaatctgattctatagagcagtctgtctctgttgtttcccttctgtccaaattttatttctttcccctaccttaaggatgtttagttacccaaatgatcaccttgagacttgattcattcagtatgttgaataataatcatagctaacacttattaggattactgtgatgcgtcaagcactgttctgcatgtttcatattaactcaatccttaccagaactgtaacagttaggtacagttattattcacatcttatggatgagggatctgaagcacagagaggttaaataaaatccctgaggtcacacagctggtacatggtggaccccagattccattctgggtagtctggctccagagcccatgctttccacccacccatagagcctctcacgatctgtcgtattgtatgcaatatatgacatattgttttaaaatacgggtgccctgttacccagctttaaaaaactcatctttgtttagtgcacatggtctcaaagtatggttcagggagtctacaaggtcataattattttccaagtagtactaagatactctttttcctttttactttcattttctcatgagtatacagaggagttttccagaatgtcatgacctgtgatatcacagcagactcaataccaaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttgaaaaagaaaaagaaagaacaaaataaagagagaaagagagaatctaactggcttctcttaagccagaagttaaagagatttgtaaaacatgtaaaataatgccactcttttcactataaattttatttatattttagaaagtataggattttttttaatttaaaaaaatgttacataatgggtttatcgttatcttttagatgaattaataaatatttgtcaaatttctcagtaaaattaatagatagagcccttaaaagcaaaagctctctgagtgctgaggccaaagcatttgaaaactaccgatttaaagtataaaccattgctattcaagtgtggtccatggcacaggaagttgttagaggtgcagaatctcaagccccacccctgacctactgaaccggagtccatgctgttaaccagaactagtttgtctgcacaatggaagttgagaagcagaggtgtagaacatctgcacgaagcgatttggcaactcagtgacctctagccaaatttcagtctggtggggctttggcgagtccattctccaattatcttgcatccaaggagctgagtgaggtcttacctatttgagattcttcagtcctactgtctcttaagtggccacaccctcatcaaagccagcagcttcagagcagggttctagtggtggttttcaaactcgggtacatcagaatcacctgggggacttctgaaagcacagatgctgggctctgcctctccccaccaaagatcctgattcagcaggtctgagataggttctgagaatttaaagttctagcaagttctcaggtgatgttgatgccacaggtctccacactgagatcttgataaacagcatttattcaagttcttatataattatgtcatgcccataggacttatgggagagaggtcttaaacttgtttcaacaccaatctcttaaaagtaaaatatatgaaaaattcaaaatttccgtctttgccaaggaggcacctgtatcttttaataagtggaaagcagtaagatatcaggcaggtcacaggtcatttagagcacggctgttctcttaaaatgatgtgagaactaaggttcagcatccttctgcactaattgcaaaatcaccacaaaatttaaacgaggagatataaatagcctgtcaagttcatttgtcattatttaaactgataacatgccattcatccagttggtcagtgctgctctgcaccagaaaccaggaacagatgagcgtacaaaccagtgaattgccatctccaagcatgagataacttggttagagtcatcagatttcctgtgctcaaaagctgccataaatccctggcctcgtgtctgttcccaggcttgcaaacccagtgccgtcgactgatacagacctttcagcaggatttgctgagctaaacaggtgtctgatgaaaagtgtgtaatcctcaaagattatcatcccctaaaagcagctggtgaccccaaactcacataatccagagagatggaagttgggagtgagtagcttgccaaagtttacactttggtgtttgaggaggttcatatggtttggtttggttccaggtagtggaagatggaggtgtgcaggggtgagggtgtctgcccctgtcgggggagatccctgtccctatccatgcccttgcctgagaacattattctactatggtccatttacactcttgaatactcctagtttaaagggaaggaattttcattttcaatgagcgttaacattacagttattatgctgggaattaaatttaatttgggaatttgggtctgcaaaaacatatcttgaccttgtctagatagttccttccttatcctaatagatctgtctacatgagataactctctaccacttttattttctcccactgggagagagttaaccatttcaaactcagggctagttaacatgagatttgattcttttactgcaagtagttaagccttaacagaggtgaggcacactcgggttccatgcagtacagcttagaaatgcttactttttatagacagaaatcacattgttcttcctttccctttaagcagacatcttgacaatcctttgaattgattatgtggcctgtatactgaaagtcagatgtcaccttccccaggataagtacttccagtaaagcaaaagaggaagccagcttttgctacgatcaagatagttgatgtggatgaggggtttatgggctaccccgttttcaattacaaggctcccactcacagagtaagtgctgttggccagcacctctggctcacagacaagttccagggaataatttcaccagcgattaattatactgcagctactgggatttgtcctccaaacatcactttgttttccatctgaaacagccaggtttctccagggagagctgaggttttctgattgaaagtatcccgagttaaggagaagtgttagagcaccatgggaatctattcaccaggggtgtactgtacttgtttcagatgcttcaggataatacaccagcttctaagataagtgctttttttttttttttttttttgagatggagtttcactcttgttgcccaggctggagtgcaatggcatgatctcggctcactgcaacctctgcctcccggattcaagtgattctcctgcctcagcctcccgagtagctgggattacaggcgcacgccaccatgcccggctagttttgtgtttttagtagagatggggtttctccatgttggtcaggctggtctcgaactcctgacctcaggtgatctgcccacctcagcctcccaaagtgctgggattacaggcatgagccaccgcgcccagccaagataagtgttttttatttccctgcatcttagatcaattatttggaatttttttggtaagttaagagctgtaacttaaaccaccacatctctatgatgtactcaataagtgaaatgttcttaccaaaaatttttcttccaatgggctatatcataattatgttgtgaagagcctagaaaaaaatagaggccgggcacagtggctcacgcctgtaatcccaacacttgagggactgaggtcaggagttcgagaccagcctgggcaaaatggtgaaaccctgtctctactaaaaatgcaaatcttagccaggcatggccactggcgcctgtaatcccagctactcaggaagctgaggaaggagaatcgcttgagcctgggaagcggaggttgcatcgagcccatatcgcaccattgcactccagcctaggcaacagagcaagtctctgtctcaaaaaaaaaaagtacaaagaaacaaaaggtggcaagaaattcgttttttaaaacatcgcatgttatgagggtcagagtagtgaagtgccaccagctgcagccttctgagaggaagtgctgctgctggttcaaatggaattctgtcctacatccaccaagcacgccagtggagtggacatgacacacacttttcttctaagctgtacagtttaacatattacaagtgagttcatttaactagtaaggaatcagaaatgtatctttgttcattttgatcgttttgatggattctgttttctcttacgtgagtagactttgtggacttccaaatggctcctggcataagtgccagttcctgctattagttccttgagggtctcatgagtcagagaggagagggaaaaacccactgcaagccatgcaggggtcccttcggatagtggccttgtgcagtctgcagtgtcggtgcacgtcatccctgcacacccgcctgctgtgctctggctggagcttgggtttgcagttgtcttctttacagcacccagggaagcatggcctcctggcaggtgttggccactccctgctttctcctggcctttgcaagcacagtgcaagggtgtttgctgaaaaagaccactgggctttcagtgtacccacacccatcagggctgatcaccctgctgccacctccccaggactcttccgtgactatcagtcatagcctgaagtctgtgtccaagggagtgtctcaggagacagccacttaacatggtaggagtagcaggtgctaaaaggtttatgcctaaatgctccccatggaccccaagttgcctgctggtttgagtggcctaacccatttaggctcaggccctgacagggtgtgtgtgcaccacttcggggtgtgaaagcatgaacagctgcggaaagcgtgggttttctgatgctggctgctgctgccttccggattagggactgtagcggggagacagaacaaaggaacacatgtgcttctgggtaagctggcccatcatagtgggggacataaggtatgggggggcacataccaccttggtatgaacactttggttgtacagaattctttcagcaaggctgagaggagtggggctttctgtccttgactgctggattcaaataagcaccagtagaggacctggggactttcacactcactgcaggggactttcaattgtgggatctcatggacaaaagggaatggttctatatccacggctctatggttctcacccccccaggagtacaaagctgggaccccccagcctcctgggtacgtttctcagcatgtgccaagcactttggaggcaggtgacggatgtgccaattatctgtattctgaggtgtgggctcccttcatactctggcaacacagagacgtagagagctcttcttcgtgttgacaggacacaatatgggctggcttcggcacagtggccatcactgtgttagcattcctgacacactgctattgaaagccccaatctgctgccaaattacatgtagacagtggtttcactgtaaaatgttgcggtgcttgtttgcattcagtcaaatactttgcacttaaacatgggttaaagagacaaataagtcaaaagaccttagcaaaacctgaagttaaatttacgcctattcttcataatggcattcagattaaagccatcaaaatgcaaaatgctgtgattatacccttcgagggttcaggctggattcttgttttgtatttctgcattactgtatttgcagtgattttgagatgcaggaaaatgcatcagaggcattgatttcttctttaacaaaaaataaccctaaaattgagaaaattcttgagaatgcagccattttggaaatgtagataaagaagaaaaatgctgaagatttgggtggtttatggagccgtatgattttgtcattgctgccacctactgtatgtggttgatgtttgtttaaacttaggaagttcatgaaggtgaggctgttgaaatagataattagagcaaggtagacatcattagcttatagcatttcttttctaccccataagtggctcttaattactgagacagccgccagctttcattcattaccttcaagtggatttaaagggctggtttctttttttttttttttttccatttttaaagttcctttgccaaggaaccttcacagtaatgctgtaaaatgcgttcaaaagcttaagatgctgggggattttctgagcatacatgcaataggttgttttaaggagtttgttttgttttgtcttaatttgtaggagcaatattctgggattggattgtaaattaatttctatgaaagaggtgaaaatggagctagtggagctgatgggagttgcagcagttgacttgaaagacattcttttattagtcctaaaacaaagcttcagatcaacctgctagttaaatgtaacaagcaatatagactctgagtcaacagaggtccttctctttttattaagacccagctgtcaaagggtcattaggtccttcctgtggaaaacaacttgcccattaatgttgggggtggtccctcgacaggatttctgagtaagtgcctgacatttcgtttttgaaagaatctaaagctgtgggagacttagatgttgagacttagcaggagtaatgtcttcaaccatagcttttagtctttgttaaatatgtcacaatatgtgtttggaatgctgctgctagctgcgtgaattgacttagagtgccactgtcaaagattcaggagcgtaaacttcacggagatcaaatcactataactgggaagaggctacattcctaaagcgaatgcacttctctgttgtgatgtttttaccttgtcactactcatattatttctagtggctcctgttctaagctctgggaatgccacagtgaggaatgcccatttattttttctgccctaggctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcaggtgagtcctgggaccctgggcagctccgtggctcaggcatcccacaccagaaagggtccctggagataggtgcattcattccagttaaagactgaggttccctaacagtattatcaaaccttttctcctaaaaataacacatgaaatgacacttttttactggttggattccagtgttctgtaccctctcattgaggtgctttctgatttttcctaacgcagataacattagtgctagcatatgtccgtatgtgaagctgaagtgaaatttcagcttgtgattacatcttgttctgccttatcacattacagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggtaatgattgtctttatcatcctaagttgtgtaacttcaatcttgtagcattcttaagctaagaaagtcattaagatcgttgtcaaaagcttggttatgtagagatagcatgtgaaatgatatggcactaatttatcctaactgaggttgcatggtaagacatgataattttattgaattgagtatgaaaaatgaaacatttatcattgattacaaagcagcatttttcactactgagagcatgtaatcagatcaaattcggtgctgagctccaaggctgcagtgtcaattgattctttgtgtttatgaacttgcttaaagtgctccttgccagtgagcatgtaatgtagtgataaaggactcaaatcaattcgctgcatcattaatactgttaaatatcccatgaaacccaatcttctttgatttgttatcctaactgatgcaaaaggttcctgagatgatgcagctggaatgtgcttggctggctggctgtcctgatcagaaccgacttagagacactttgccattgatcctcagaggctctggctgtgtaactgccctctcactggccaccatttttaccctccccacttaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaaggtaggtgtctgtttagattttctgtgagtcgcgttcaatcaaatcttatttgtcattgcagacattctgtctattagtatttgtttcactctctgttctttagtcgtagtttatgtgtacccagtcccgctgatcatatatcataatcgtttatctcacagtcatgattatgtttacttttcaggtttgttagtgcggtgacaggaaaccagggacaggccagcctcctagtctagtagtcactgccacctgctggtctgcaggagtagagtaactgaggtttatgggaacaaaaaggggccccagaaagcacttaaaccaccctccaagacctagaggccaggagacttctctaaggtcatatgactcattagagatggaagcagaaccaaatgcgtgctcaagactctaagcctgggttgggcgcagtggctcacgcctgtaatcccagcactttgggaggccaaggtgggcagatcacctgaggtcaggagttcaagaccagcctggctaacgtggtgaaatcccgtctctgctaaaaatacaaaaaattagccagacacggtagtacgcgcctgtaatcccagctactcgggaggctgagacaggagaacccagggaggcagaggttgcagtaagccgagatcgcaccattgcactccagcctgggcaacaagagcgaaactctgtctcaaaacagaacaaaaagactccaagcccagtgctcttcatgctgtttctttctcttgttcttggcacagaattgttagaaagcattttaggcccttaattttgatggtgatattttgcatttgtggccaactgcgcattactgaatctcctcagatcttagtagcccagtgatgtctctagatagaccatatcatctccaatggtacagaaagtaaagaattgactttgtttttaggtaactgctcacccagatctgatatctttgtcttcagtatctatctgggacatagaggagagccaagactgatagagatatcacaatacaagctaaggctccgccccaaggccatctgatgtggcatctgttagggaacttgctgttctaactcccagctcagcgctcttctaggcctggcagtcttctggaagggtctccatggggaggtggtagaaaggagcatcccacaaagtagacttcaggcttaagaataatgtttccatttcttaggaggagtgtgtattcatgtgttgtatatataataaaagaaatttgttctaaaactatcaaaaaccagaatcatccaaggcatgatctgaactggactcaacctgaagaaaaccagttctctaccttggcttccctcatattagggaaaattctcatggattaaagagggcaggcagactggggggaataataaccgtaaatgtttaattacagaatatgattaactggctacgtgtgtgcttcagtgagcattcagagcgttaacaaaagtaagacacaagaattcttggaggccggacacagtggctcacgcctataatccccacactttgggaagctgaggcaggaggatcatttgagctcaggagttcaagaccagcctgggcaacaaagcaagactctgtctctataaaaaataaataagtatttttaaaataataataataataattgaatacagtttacctgaaggttagcttttaaccaagcatattgaacccttctttgcagtgtattttcaataatttggggggcaacaattacatcttagcagcaaatctacctgctattcctctatttgaattttgtgtcattaaaaacttttttgctgggcgaaaaacattttataattacaattatggacagtcatttgtgccaacctttagtgcaaacagaaaaaatatttttaggccaggtgcggtggctcacacctataatcccagcactctgggaggccaaggcgggtggaccacttgagctcaggggttcgagaccagcctaggcaacatggcaaagccctgtctctacaaaaaagaaaaataaaagaaaaaaatatttttatatcatacaaataagacatctggcatgtctttaacatttttagattccttctattaaaatattttgccaggttatcagttgctcacatctcagcagccaccaatacttgactttgttaacattttaaacagtaatcctttcttcaggtacctttcctttccttttcatagccctgaagtcctatggaatgagaaaaagtaggctggtcttgtatcatatttcccagtgctgtccacatagtgggtgctccttcaagagttctcaagtattaaatgggttaacccagtggctagttaattacagcaccatttataaagacattagagtctgtgatgaccttaaatgtctgtgatgtgaggaatattgaagccagcaagtaccattggaaaaatatatgctagaaaagcaaagcttagtttttaaaatctccagtcaagctgctaggatgttccctctcagagcatctgcttgagtaaacaactgttttatttggaaaacacttgcctgtgtagttggagcccgagagggatgttagacatcaaatggaaggttaagtacaaaggcattacagaagtcaccacgtgtaagattctcagacacgcgttcagtacatgtctactgcatatcgactcaaccatttaatttctcatgagctcttatgtgttatgtttggaattaatttcagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaagtaagtagaggaatgataaaaaccttacccttgagaatgtctgtatctgactgggtgccaaagagcaggcctctggcgtgatgcccagaggcacctgcgaagtggtgctgatgcacctggagcaagtgcccatctgccctttcccatccttacaagcttctctcccttcttcctggaattggattttatgttaaacaacttctaaggccagaacattcctctaggtgggttcatcttacttaccagaaattggcttatccccaaaaactttgaagtctgttgacaagaaacacattacatttctttgattctaatatgtacttttttttttcacatttagttatttctgaaatcaaggtatatattattatcagtgtgagcattgaatggaatcgtttcttttttcctggaaaacaaatattagtaaatcaatagtacattttataatcagtagtgtcgtagtatatactactataaagattcatctaaactaagctgggcatgatggcttacacctgtaatcccagcactttgggaggctgaggcaggtggatcacttgagcccaggagtttgagaccaacctaggcaacatggcaaagcccctactctaaaaaaaatacaaaaattaatcagatgtagtggtgtgcacctgtagtctcagcacttttggagactgaggcagctggatcacttgagcccaggagtttgagaccagcctgagcgacatggcaaaaccccatctctacaaaagatacaaaaattagtcagcagtggtggtgtgtgcctatagtcccagctacttgggaggctgaggtgggaggatcacctgagctcagggtgagccatgatcgtgccactgcactccagcctgggtgacagaatgagaccctttctcaaaaaaaaaaaaaaaaaaaggaaccatctaaacttacccacacatcaatattagctttgataatattgcataacataaaaatcagtaaactgactttccttttaagttgacagggacacctctaccccatcctctaaaaaatacactgaacaccagtgaatcgtctttaaaagcacccatccttgcctgtcaggttgagaacgtgtgctcccagctgaatcatgagggtttatggtatactctctctattccctggccaagatgactctattcagaacttactttaatctggggaacaggccatctcatttccctgggaaccacaggatcactctagcttttgaaaagccacagttttaagaacatatgcaagcatcttcttgattttcttagttcacagaaatgctattcctgcatacagtattttgctgaaggaatgacttcttaccctgggtatagagaaaccaagccttattctttgggttttttttttttaaacaaataacaaactgcagtgagcgatcattttgtgtgtgaaaatgaggtttatttccccttcttggctgtcttctcatattatgcctgattcctttcaggatgtccttctttcttaaaaataattgtcagaaagctcatcttctgattttgggaggtgttccaacaaaagccggtaggtccagtagcacgtagaataagaatgcagaatccagccaggcatggtggctcatgcctgtaatcccagcactttgggcggccgaggtaggcagatcacctgaggtcaggagttcaagaccagcctgaccaacatggtgaaaccccatctctaccaaaagtacaaaaaaattagctgggtgtggtgatgcatgcctgtaagtcccagctacttgggaggctgaggcaggagaatcgcttgaacctgggagacagaggttgcagtgagccgagatcatgccactgcactccagcctgggcaacagagcaagactccgtctcaaaaataaaaagaatgtggaatccgggggcactggcatggctattacctgccattgtgaatagaaatgtcctgagatgactcttaactcgggcatggtactcggcacttctcaaggaaacattctacatcacatatgtgttcttttcagctggtcggtttgaatgtaatacttgcaggtaagtttatctgtaatccttttattacctaaatcagccagtgcttactctgctgtccaccagttggactagaactcactctattctggcagaagggatatctgttttatgatgattgtgagatcttatttttattctccaaaatagagtttctaataagactattgttctatataaagcttttcctttaaattgaccactgattctagaagattggtgtaatctaaagatcttaagaatacttgggtgcttcatgcatatatttattaatatatatttattaatatgtatatagctattcatctgcttgtataaatatgtacatatttacatttatattaacatgtgcatataggttcagtaaaaagctcacctgaactgaaatgaacttcacaattatggtttgtttctaagtgtctttaatatgcaaaccttacatcagcaacatattgatccagaattcagtgtggacagaattagtgttaaaaagaatacctgtattttaaatgttcaggaatttgctagtaattacattgtagtttgtatcatgcaaaaatgatgatcctaaaaatgatgattacaaatgcatttgttttgggtatttagttatttactgatttgtttcagaggtacacagcttatttttatgccagagagaacattcaaatcaaagtaaataaatcatgtcttccaagatcatttacatcctataaatgtccacaaacagaggtttactttctctaggtagatatgagagttaaggcttctagtcatttttccaggacagtaatgatttgtatataagctagcattaattcctttcccctatatttcctaatttgtaaatgttcaaattgatttttttttttacactgtggaactctgggcttttgcatcagagaatgtcttgttcattaaattcaaataagcacattagcattgcctatatccatgtgttcccaatatgttactctcccaggcctaggttatttacttggtttataacacaatattattacacattagccttgattatgtctttaccatcaacttttaacatgccaaattgaaagcagtgtttgctaattaatttagaggaatgaattcaagttgcccatggttatgctttctaagactgttttttttccttcccgtttttgtctcttcactaagacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 281 - DNA, 206210 bp, Homo sapiens; identical to SEQ ID NO: 280

SEQ ID NO: 282 - DNA, 206210 bp, Homo sapiens; identical to SEQ ID NO: 280

SEQ ID NO: 283 - DNA, 55247 bp, Homo sapiens
acagtgttcgcggctgcaccgctcggaggctgggtgacccgcgtagaagtgaagtacttttttatttgcagacctgggccgatgccgctttaaaaaacgcgaggggctctatgcacctccctggcggtagttcctccgacctcagccgggtcgggtcgtgccgccctctcccaggagagacaaacaggtgtcccacgtggcagccgcgccccgggcgcccctcctgtgatcccgtagcgccccctggcccgagccgcgcccgggtctgtgagtagagccgcccgggcaccgagcgctggtcgccgctctccttccggtgagtcccagccccgagttggctctggcgcccgggtacccgccagtgccggctgccgatgaccgattcacgctcccggtactggggccccctctgcccagccacccctacccagagcacccgggctgcgcggccccgccgagggtgcgggctttgttcgcattgtctgcgcgcacctgagcgcggccttcctggcacggcggcgtcgggggaagagcgcacctggcgcgcgcctccctcgtggccactcgcggtccgtcccgggcgagctggcggggttttgggaggggtgcggtcagcaggtaagtgggtaggggctccgggtacaggggtggaggagggcatgtattaaacccaagctgccctcctggcacagtagcggggcccccttccctggcggccgcggaaagggactcgccctttgaataaaggctttggtgacatgctcgcttccaccccacaccccactacaggacatacacaggtgttaaggggacttggggcagttttcccaggcagaacgagtgcccccagcgaagtgtctgcaagcagaacctgagaggggccggctgccccgagagtcctcgcgcttgggcagtgggaagtccaggggtttgtcgttctggtgacttcccccacctggctcagccctgcttcctgcatgtctccttcccttccaataaggctaacaaaactttccctagctaagccgacctttccctcccgccttgggcccttggccacctgctgggacggtgaatgggagagtctcagaattgaaccttgaaaacttgctgggggcaccagacagaagagaagggaggagggcaccttgctgcttgtgattgtggaatcaagggctccagctgaagctgaaaggggacttagcaatggggacctcatgccatgtgtttgatgtcttggagattggaataattagaacgtgtacatttttcaaattacaagctgctttaagtaaaaccccagaacctctaagtgttttataaattcagtcccaaaaattcaaggtctcttttgctgttaaggtgacactatattaagaaatgtcgatttattgaagagtcagagaagtgaagaggtcagaaaggtaccactagagttggcaaaagccacaggcatgaatttgtaaatgctgctggctttcagcaggctgaagccatcctctcttgtgactgatgggggttcagagctcctcaggccttactcttcttttgtaaaatccagcccagagccatctcctagtagtgtaagaatttctcagactaggtccccaggcaaatcccaggttggagaagaggattgctttcctcatcatctctggctgaaaaccatcagtgtattttcattaaatctggtttttggtctaccgtacagagattacagccagtatttcccctctcttcaataggcacaagcccctgggatatccgaatcatagtcagaagcccatgtttttacagatgaggaaactgagacccagttttagagtgttaggttcaaagcaaaattgagcagaaggtacaggtttcccatatacctcctgtccccgcctatgcacagactcccccattgtcagcatcccccactgcagtggtacatttgttccaactgatgaaccgacactggcacatcattatgacccaaagttcacagtttgccctggggtttgctcctgttgtacattctatggctttggacaaatgtaaaatgacataaatctgccattatagtatcaaacagcatagtttcactaccgtaaaaatcttctgtgcatcccaccctccctacaacacatggtaatcactgatctttctactgtctcaatagttttaccttttccagaatgtcttatgattggaatcatgtagtacgtagctttctcagattggtgtctttcgctcggtaatatacactgacatttcccctcctggctttttaatgagcatcataaaaacagaatagttatttggcagtgacggcatcataagcttgtggtgaaaatgccttttttgttaataactcccctgatgtgtgtgcatcttacaaagcattgtcctcacatcctcagtacctggaagggtaccgggcacagggcagatgcttaataatttttactgggtaaatgaaatttcatgtaattatagcaatgagagggtcagcaacactacgaggttgttttagaacagtggtcctcaaacttttgcagtgcatatatcagtaaatgaaaacctagtttaattgggaggcctgcaatagaattgctcatttttaattttatccaataaggctattttaaaacaaatcccacccccctccctatcatcaaggaggctattggaagtctgttggtgattgtgtgtgtgcattccctgcaaaatgtttctgtataaccccaaggcagcacagtgggacagctgaatgtatttgaagtcccttcctttgtgtgacctttcgtcttctaaacagctctggactgcttaattttcctcttccacctaccacattagctgctgactttccttgaatgtgattactaccctcggtcctccccttccttttcctgatcatgagtctcttctcttgaactagatttccctggtctcaaattaggaaactttgcccttgccccgggagcctttgcatcgtggtttcatggggtcctggcgacaacctttccagggaaataggatggatggtgttacctccgttttagagagaaggaaattgagagactgaagtggaggaatttacccaggaggctcatgctcaggtatcctgccatcagatggttgctctttccagagcatctgtgtaccgcatgcctcatagtaccaggtgcatctgcatgccgatgcctctgtgtaccacgtgcctctgtgtaccagtgcctctgcataccgcagtgcccctgtgtaccagtaaatctgtgtatcagtgcctctgcataccagtgcatctgtgtactgtgtgcctctgcgtactggtgcctctgtgtaccgcatgtctctgtgtaccacgtgcctctgtgtaccagtgcatctgtgtaccgcgtacttctggtcatagctgagaagtcctgggctggactctaagctgggtttttctcgctctgtggccttgggtctcgtcttctccaagatcatttcttcatctataaagatgtaaatgataatatctaccctacagattatgggtgttgttaaatgaaatgaatatattaaatgtaatgataaacttttaacatcattcatttagaaaacattttactatttagcagagacttttctaccctgtctcactggatctttacaacactgggggagtttatgaaacagattctccccatttggcagatgaggaactaaggcaggggaggttgttgcttgcagtcacccagctgctaggagcagagctaggttggaatcctgtctctggactttgggtcctgtgtgtgttctcccacacctcagggctaatcccagtgtcccatacagtgaaatcgggttgtgtacaatttaaagcattttcagatatcatccatcaaaacaaacatgaactctcttctggctaaaaatgtgtctgcagatgcagaaagtatgggagggcttgtgatctatgcccatcttcccagcttttctccctaaccctccagggagttcacaaatggcatgttgcttatttcttggtgcggacttttggttgttaggccactgggttctgaaaatttactaattattttagggggagcgtgactttccccaggcagctttttaaatgctctctctgccatatcaaactagaaatgtgtcatctacctccgttgacactctgagcctgagccaaatattttaccaaaggttacaaggaagatgattgttccagcaaggacttccccaccggatatttttacctctgattttagtcttcccattcaggtgtgtactgttctggtaaagggctcagatttccatcctgctgatttggaggaggctgccaacggctaatctatttggggttggaattgcattttgtaaggaggtagaaatggtttcctctttttccctacactcatttcatttccgatggtagagaaggcagacattatcctgcaaaactgccttcagcgatccccaatccggctcttctttttttaaaaagtagctttgttttggcttttatttcttcctgtgtcacggaaaatgtaattcctgggtagtgcacagtggaaatttttgtggcatcctgcagcagacttcacatgcctgctgtcccaagtgcagctggtgctgcgtgggaaccaggatccgaaggccacactctgttgaggagatcaggggcgtggagagcatctacatccatggatgagaactccagaagccaggaataacaagtgggattagcatgagtaatggaacagaagggaacaaggtgatgagcgaggtgtaacggaaaaggcttggtgaggcatacctgagaatgggtggtctgttccagcccctggcttgcagatcactcccaactactttgtaggaagccagagggccctggtaaatctcatcttgtgccggatggagtgtgagagctgctggcaggtattagctgggggagaaattgccaacgtgcaggattcagggtggcagattttttaaattatgcttctgtgcttctgaactgcctctagttcatagcctgttttctggagcctggacttctgccagagtgtcacctcttaccggcagccccaacacctctcccttgttgaacatcctgtggcagcttcccccagaaccgggaaggtgacgctaggaggccagaatggaatctgatccactgattagctgtgtaagctggggcagaacacttcacttctccatgtctcagcttcctcacctgtgaaatgggaatagtacaccctccctggctggctgcgaggattaggagagaagacatgaagggcggagcctgtgtgtcttgtggcaggcacataagaaatgctcattacatggtagtagctgttgatttttattgtggaattcaccctttaaaaaaaaagctttccaggtgtagggctgtattttggaggtcaaattagtattgtaggaaaattttgatatgagaggggaatgagctgcctattcgagatgactggatgggaatagagtgcaaacaatacttcaacatcatcgcaatagcgttcatttcattaatcttggtataaaaaagaatgcagtgaacacagtgagtgcaatgatgccctgaaagggtccctctagccctcccacaggaggtattctggtgctttgtttatctagcaagcaaggacctcccctactatacatcaggcacatgcaggtctctggagctccagcagagactagatagtctgtagtctcaggcatttgccgcctggcagtcaagacaaacgtatcactgggcagtttcagcgtgggctgtgtgacagtagggattgtattgagggggacaggggagggaggtgctgcagaagttgcagagccaacaccgtctgattgatccaaacagctaggagaaggcatttgacatcctgtgtgcatttgcagattgccaacatacattctattttaatgagcagaaacttgggcgcctctggaaaaacatgcagctgggcaagcagaggcacatagtggatcgagatcaagctgcttaagttggtctcatagcacggagggaaggggactgtgtttactgggtgccttcctatgtggcaggaaccttctgtacttccttccactttatcctcacagcagcctggggaggtggctgccagaatccttgttttataaataattaacaggcctgagcctcagtctcctgccagtgcccagggtcagaagctgtaactccgtaaaatcgtcctgaacctaaggaatagagacagcattgagaagctcttcaccgcatcctcaatgcctcgccattgcctgactcacaggcggcaggtgggggcttgttctgcctctgtggtgtggagtaagagggaaaaaaaaaatgtccttaggggaaaatgagtctttcttgctggcatgcacagggctggaagctagcaggaagtatgtgctgcaggccagtatccttctcaccacctttctccctttgatcgtgtctgtagagctcctgacatactggctcttgccatgttaggtgtctgattttcacttagatcaggagaagacttgagcctcttagtcatttgaagcaggaagaccctgcacgaagactctcagctggcagggacatttgttttataatagtttgttttaggactgctttgaaatccaaggagctctatagacagttccaagtggtgcatattttagaattaggtagaatctggtggcatcatggaaataaccacacagtctgagaatattgggtggtcagtacatgctccatcctccaggaggaccactctctgtggcaccctggactacctgcccccgccccccgcccaagatgattggaggtcagatgcatggtgagaaggtagatctctggagccttggtgttctttgctatgaatttttagttgggaagcctccttttgaggcaaacgtacaccaagagacctacaaaagaatatcacgggttgggctgggcatggtggctcacgcctgtaatcccagcacttcgggaggccgaggcggtcgtatcacctgaggtcaggagttcaagaccagcctgatcaacatggtgaaaccccgtctctactaaaaatacaaaaattagctgggcgtggtggcgcatgcctgtaatcccagctactcagaaggctgagacaggagaatcgcttgaacccgggaggcagaggtagcagtgagccaagaccatgccattgcattccagcctgggcaacaagagtgaaagaaactccatctcaaaaaaaaaaaaaaaaaaaacgagtatcatgggttgaattcacattccctgactgtaacagagggacccaggacctcattttaagactgttgaagcataatcccagccagaggccaatgctcagagaagtacttgaacacccctggatcacagcaaattcatcaaaaccattaaattcccaaaacaaagaatcaactagcaaacagtcttaggaatcgtgcagggggagaaatccttgaaccagggctgctgtataacctttcaggaacatgctactaaaatttattttaccattgactgctgccctcaatctagagcgctacaagaaatatttgttttactgagcacctggcaatgcctgaacctccctattcagaaagctccacatcaataaacatgacactctgaagtgaaagtagccacaagaattgtgctacttatactggttcgtaatctggaggcaaggttccgctgcagctgccccctcagcctgggccaggcatggtttcttcccaggagacaaatccagagtgtggctgtggggaaagtgaccactttgccctgactcgatcggttaaggagctgtgcaataaccttcccagtacctgagtgagtgtgtcacttattgggttggccaagcctagtaaagctgttggaatgaggatgtgattctttttaagtgtgaaaaaaaaaaaaaagatttctgtacagatttgtatttgttctctggtggcattcccttagaaatgctctgtgtctgtccagcaccccggtaggcctggttgggtttctagtcatctttaaccacttatctcccatatgagagtgtataaaataggaacacatgctctacctccatttagggacttgcaacctctgcatcccaggttcaagtgattctcctgcctcagcctcctgagtagctggaattataggtgcccaccaccatgtctggctaattttttgtattttcagtagagacactgtttcaccgtgttggccaggctggtcgtgaactcctgaactcaggtgatccacctgcctcggcctcccaaagtgctgggattacagacaagagccaccgcgaagggcttattttttaaaaaacactggagtcatggcatgtgtgtaaactttaaatatgcaaataactatgtcaaaaaaaaaaacaaaacggagctggatgtatcttgaggtccaaacatcataggtccatgatggaggcaggagtccaatgggacttttaaaaccataaaacagcttagccacatcagggcccttctcttcactttgtaagggaggaaccacagcctctcccaaggtcacagggcaccaggatgaggatgagggcccctgggttcatgtaggctctctgccaccatggggcaggtgtggctcctgcatgggtggtgaagtttttttttaaaaaaacttctcaaaaaataatttttctcagccaagtgtggtggcatgtacctgtagtcccagctactcgggaggctgaggcacaaaaatcacttgaaccccgggaggcggaggttgcagtgagccaagatcgtgccactgcattccagcctgggctacagaataagactccatctcaaaaaaaaaaaaaaaagtcctcttccttcagccggattacgatttataaataatttagatgattagtggataatttagatagtgcaggctttcttcagatgttgtcttcttagctaggggaaggtttgttaaccacattagaaggtttcagaagatgaggacattgaaaatcagatcttcagcctgttgaattctaactcctcatgaagaaatggagaccctgagaaagaagtgactttgcccagggtcacgtggctagtcagggcccaggcagagccaacacccgggcctcttaactctggggagagcaggagagcacaccttcccagggcccgtggagggctggggtgcatttgggggtggatgagagaggtatcctggggaagatgttagcttggtgtctaaaaccaaagtaattggagtaaagtcttccatgacttgggaattggggacttttctagttattgtggtgagggcctccagggtcatatctgtgacctggaaaaggctgagttggcatcttgtttggcggtgtgacttggggcgttcacagaactaattgctgatactttctttcttttcctgtgtccctgtagttatatcaacatgccccctttcctgttgctggaagccgtctgtgttttcctgttttccagaggtaagatgtgtttattggtggtggggaagtactggcgtgttgagtaggggggttgcttgcttcaaatcctgttgattttcaattctaaaggtctcttgaatccacctgcatctcccctccatggccacctccctagtccaagccatgtcatcttgtgcttggaccactgcagtagcctcctgcctggcctccctgggtcccccggtcctcctccaacccattctccatgcagtggctatttctttttttatttttaagttccagggtacatgtgcacgatgtgcaggttcgttacataggtaaatgtgtgccatggtgtgtgccatgatggtttgctgcacctatcaacccatcacttaggtattgagcccagcaggcattagctatttatcctgatgctctccctccccaccccaccactcgacaggccccagtgtgtgttgtttccatccccatgtccatatgttctcattgttcagctcccacttattttatttatttatttatttgagatggaatctctctctgtcacccagactggagtgcaatggcgcaatctctgctcactgtaacttccacctcccggttcaagtgattctccagcctcagcctcttgagtagctgagatgagaggcacgcaccaccacacccggctaatttttgtatttttagtagagaaggggtttcaccatattggtcaggctggtcttgaactcctgacctcaggtgatctgaccgtcttggcctcccaaagtgctaggattacaggcatgagccactgcgcctggccctcagctcccacttgtaagtgagaatatgcggtgtttggttttctgttccggcattagtttgctgaggagaatggcttctagctccacccatgtccctgcaaaggacgtgatcttgttcctttttatggctgcatggtattccatggtgtatatgtaccacatgttctctatccagtctatcattgatcagcatttgggttgactccatgtctttacagcggccatttcaaaatgcaaattggatcatgtctggacccctcttcacccccagctaaaacttttcagtgactttctgtggctcttaagaggcttttctcatcttaccccgtggccatcctgagtcccctctacgccctctgcaccacagcccactctccttccagtcctgccctgcatccttgctccccgccaccaaaaacattctgaattatgttgcccctgtgcttggatcaccccctcatcccaacactgccaccctggcaaactcctccccatccttaggccccagcacaattcccctgggacctccagatcaagtcacatccccctcttcaaaccccttgtagaccttgctctgtagcacttaacacagatatgagttttgtgtgcattttaaaaaatgacatcttttccataagatgtaaggtcctcaaggaaagagactgtacattctttaacattctttattcaccactatattatttcagggcgggcatggctcacggtttatgcttcagaaatagattaatgaataaataatggagcaaatccactttctttttacttcccactttttccctttcaagttctagtctctttgaaatatgagaaggtaggaaggaattgatgtgtctgcagattgttgtcttacaagtaagaacaggtggactgggcggccaagctgtcacagcctcgtgaggctcggggtccccttctgtaaagccaaggggttgcacagtggcctctgggattatttcttgcagttcctccctggtctgtgtttccatgagtaggtatttgttctctgctgaattggctactgttaatacctgcctgtttcctggaacctagcgaggatcagaaatgctggtggaagttgagggctggtggctccagcctggctgcccagcccaactgtttccctctgtctctgagccaggtggggtggatggaaagtataacacagcagcttcatggccaaggggttggggagtggtgagatgtgtttggggccagggcctgaaagaagtctctggagtcctgggcacagtccaggttctgttccagcttgtcatggacctttgccttctgtggccctgtccagcctccagattgcaatcacatgcacttgttctgatcatccttgggttatacagatgaggcaggggaggcccagagaggccctgtgacatgcccaaggtcacacagctatgtagcagacatgggactaacacccagttctccctactcctgggctggctgtaccgctcagcttctctggaaagataagaatgtacaaaagttctctctaagacttggctgtcacatctgtaaagtgaaagaatttgactagattagtgattctcaactctgcctgcgcaatagcgtcacccatcctgcagactgaagttccggagcccaggcagctggtctttagagggggctgccgacttggttggaaaaagcaacagcaatcacacatgaagcagctgcctgttcagggggagcctctgcagtcctgaagacatttcacagggagcattggggatgtcacccaggctcaaggtgggctcatctgaagcctggcacctgccatgacagctgagcacagggcacagaggcacagttagttagctgagtgacatctttagtgagtggtctgtgctcacagagctcccttgccttctcatcctggggagatggctggcctgccttcagctggagagtttgctggtaagatattttaaaagaaactgtatttttctgttctttttggggtctttaggattcctcggctactgggccctttgtcaggagaataattcatggactcagctcaggaaaccttagtgcctatgtgtttacgcagagggctgggcgaggctctgtggaggactgggtggaaatgcttctgtcctcagggagcttccaggcaggaaggtgaggggctcgtgggaacagaaccgcattatggggtgggccgcagtgggcccaggagttggcatggtcgtgatctctgaatgcagtgagcagaaaacctgtaatttttttttttttttttttttgagattcagtctccctctcgcccaggctggagtgcagtggtgcactcttggctcactgcaacctccgcctcccgggttcaagtgattcaactgcctcagcctcgaaagtagcctcgaaacacacccagctaatttttgtgtttttagtagagatggggtttcaccctgttggccaggctgttcttgaacccctgacctcaggtgatccaccgcctcagtctcccaaagtgctgggattacaggcgtgagccaccccgctggcctgtttttctttttaatgctgcccctgcctctgtcccaataaatgccattttttaaatgcaagtagatttttctttaattttgtctactgtctttctttctagtctaagtcttgtttctgtctctggtggcaaaacagcagcggcagactgtgccagacctaatgagagagatttgtctggcagcttttggctgtggagctgactgctggcacattgacttagaatctccatgagtagagattgaggggaggagggagtattaggtgagcaggagctgtctgctcaaagatatggtatggggagagactagtttagtttgcatgggggactagtgaacgggaaggagccgggaaagacagagctggaaccagccgaggcagtgctgagttagtaggttgaccaataacgtgggtcattggtgtcactcccccagactgaaaccctcttttggcgtctctcttgtcatcactttcctggcagttgcaaaccttgagaccaggtgccctgtactgtgtgattcctcctggcctccctgctgaatctccttcacctctctccacagcagcccccatgctcatctgccattcaggttcaaacagttctcctgcctcagcctcccaagtagctggaactataggcgcccgccagcacacccggctaatttttgtatttttagtagagatggggtttcaccatgttggccaggctggtcttgaactcctgacctcaggtgatcggcccacctcggtctcccaaagtgctgggattacaggcatgagccactgcacccggcctgcttgtgttccttcatctgccccacttccgtgacctggccgctcctgggctctgcccctctagctttgtttcctctgtgctgtcactgcacattgacatttacaaagcatctgagtgtacctctcttctgctgctagacacctaccaggtgcagttgcagagaggatgttggcttttccaaatgtcccttctggggatcccttattgtcttccatcatggttggttcactgttcagcaatcctgtggcctcctcagtgtcttatccccaccctccaatttcatttcccctcccctctctcctctcccctctcccccctccccgtcccccctccccgtctctccctcccccgtccccgtctcccccctcctctcccccactcccccctcctctccccactccccccagttattacacctgacctgacacctcacccccctccccgcttattacacctgaccagggacaaaagttttcagaatcacagactctctagaaccccactgtgtgttagttttattctttgtcttcaaactacccacatttaaatacaaagatacctcatagaagtgaggtaattggggggtttctttatgttatccgtctggtaatttttgagatgcaagaatcatcactcccccacattctaggtttctctgatgttacctgtttagtcaagtcacttaatgtggagattgagcctcctcccctctcagcattttaatggctgcttctggtgttttctctcctagtgcccccatctctccctctccaggaagtccatgtaagcaaagaaaccatcgggaagatttcagctgccagcaaaagtaagcccaggttcttcttaaccctccagatgcccactcagacctctgtgtgatggactggatgagaaccatgttcttccagagagtttctgcccctttcccatcttcctttcatgctctggccagagtcattttccccaaacagggacctgaccaaatcacttggtttaaaaacaaacaaaagtgggtgcctgtaattccagctactcgggaggctgaggcaggagaattgcttgaacccaggaggtggaggttgcagtgagctgagattgcgccattgcactccagcctgggcaacaagaggtacactccatctcaaaaacaagcaaaacagctcagtaaacctttttttgttttgttttaaagacagggtcttgctcctgtcgcccaggctggagtgcgatggcataatctcagttcactgcagcctcaacctcctgggctcaagcaatcctcctgcctcagcctcccaaatagctgggaccataggcatgcatcaccacgcctagctagtttttgtgtttttagtagagatggggtttcgccatgttacccaggctgatctcgaactcctgaactcaagcaatccgcccgcgttggtctcccaaagtgctgagattccaggtgtgagccaccatgcccagcctcagtaaatctttattattgaattacttggcctgtgcctcaaggttttctgttacctgctcaccaggtaacggggtggctacttgccatgtccatctcccaccatattccttcctcttccaccctcatcagtatccctccacattgctgctgttactgctactgaactcttgggtaacatggcctcacatatcagggtgcctgtgtccacactagactgtggtcccccgaggcctgggaccaagccttttcagtgctgctcactagcccagtagaccccctcatagaacgtaattgatattgttgaactaggttcttccattattgtaatacaaaggctttcacgtaagggcacatttgtgagcagcacacctgtggtgcgtgtgcttcctgcttcagaggagggctgcttctgcagttctcccctttcatgctaagagggacagcagcctggcccaccacaaggctgtttgtgccttcactctgcttcagaagtgagaccgacttgctcctggttgtcatctgtctgtcccgctctccctagtgatgtggtgctcggctgcagtggacatcatgtttctgttagatgggtctaacagcgtcgggaaagggagctttgaaaggtccaagcactttgccatcacagtctgtgacggtctggacatcagccccgagagggtgagtgcaagtcttgtgggtgtttgtgttagggcgtcttctgtgataagggacagaaacccggtctcaagcagaggaggcatctactcgcttgtggagctgggaagaccaaggggctgaatcctggttcctggcatggtgggatccaagggctgagttgaggctataaggcatctttttctttttttttttttcccttctctcaattttgttttcttttggttgacttccttctcaggcaggttttcctgacacagccaagttgtcctgcattgttcctcaagctagtgaccctattagaaattaaggggacttctttctctagatctggccaaagtcccaggagggttctgattgggcaggcctaggtcacatgataatccactgaccaatcacagtagtcagagggaagagagtttctggccggacctcagttaagagctctgccatgtttttggggtagggagtagatttgactttcctctggaaagagaggttgggttgtgtttgcagaacaatgggaaagggaaagcatgctaagcagactaaagctgttactacctcagtggactgaatagcacagctcctaccctctcttgcacttgagaggaactattcctgcttgagtgaatccagccagtatcttcatttcttgttcttcaaatagtaggtcttaaatatagcagagtgtggtagctgtggctcttatttctaaaaggggcatttttttttttaacaatccaatagaaaaatgggcaaggaacacagatagttcccagaaaatgaaacacgcaaggccttcaggcatatgaaaagaagcccaacctcactcactcagagtcagcaaaccctatgcctaatatacagtttttcacttactgggttagcaaaaaaaatcctaaatttggtgacatgcttcattggcaaatcttgaaaaaaactggtgttgtcatacactgctggtggagtgtgaaatggtgcagcctctaggggagaatccaatagtattcatcccagttacaaaggcttggaccctttaacccagcaattctacatcaaggaatttattctacagtacacatgcccatgcaaaatcgtacccatacagagttattcattgcagcattatgtgtataaactgtaaaatatttcaggcaatccagatgtacgctgagggaggacagataaatcccttatgatgcattcgtatattgaaacgctaggcagctccagaaagtgagtgaggaagctctctgatatggaaaaacaccagaacaagtgaagtgtcaaagtaaggtgcaaatggtgtgtataatatgttactttctatgtaaaagataaagggggatgaatgaaaatctgtctttgttttcttgtatcggtatacagttttcttatatctgtatacactctggatggatttgtaagaggctgaggacagtggttttcattaagggggaggttgggaagtgagttgacagggcacaaggccagaggcagactcatcaatacagacttaaatattttctggattttgaatcacgtgaacctactcaaaagtcaacttaaaaattaagagaggctgtgcgcggtgggtcacgcctgtaatcccagtacttagggaggccaaggcgggtggatcacgaggtcaggagattgagaccgtcctggctaacatgatgaaaccttgtctctactaaaaatacaaaaaattagccgggcatggtggcacgtgcctgtagtcccagctactcggaaggctgaggcaggaaaatcgcttgaacccaggaggcagaggttgcagtgagctgagatggtgccactgcactccagcctgggcgacagagtgaaacaccgtctcaaaaaaaaaaaaaaaaaaaaaaattaagagatgatgtagcctggaaaagctgtcattacttggatgagagactggttgcatacaggttgaggaaggaagtggttttccaagataacattcctagattaatcctagttaaaacctctaggatttagaaacatacatggcttttaatgagggccagattttctgcagaatggtgtgtcatttggggagctggagcacacttcctggaccttagaccaccttgcacctgaggacaccatagcaggcatcatttaatctaggcacaagcagcccagaagatttctaaccatgatgttaacccagcatagaccctaaaagggccaggcaagaagcgccagttccccaccatcctctgcacaggaccctgcttttaaaagggttccttatcaggtgtcattagttactcatggaggaataacataaagagaagaagcatgaagattaaacactgttgaccttggcattgatgtagtgtgtcctgaaatgagtagcctggagaccctggggttggctagttgggaatgaagggtcctatggattattaatgcatgtttcacagatgagggaacaggctcagagaggctaagtgactgccgagggtcacacagcaacctcaggagagagttaagtgtggaagaactggggcttttgactcagcccaggacttgctccattaggccatttgtcttgaccctcagaattcacaccctgctatcacacagcaaatggccagcagtgtggcagtgtatgtgcgtgtgaggagggagtggtgtaagaaaaccgtgacaagaaatttcctggctgatgctattgggagcagatcccagagttcagggaatttaacctgagcattgctggaccacatctagaaagtgtcattgagttctaggggctgacttcttggttagacttgggccaaacagtcagtgcccatgagaaggagccaggacagccagaggcctggaaacctctatgaatgagggaacacgattatcattttcatgtgaaagagagcagacaatggctctgttttttaagggtagaatctgggtgttcagggagttagatttgggcttaacctgaggaaagctttcttgcagcaagacttgggaagcagaggaattgtttacttgggtaagtgaattagtgtcttgacctccaaggtcaggtggaccccttggcatgctgcagaagggtttgcatgagggcaatttaagatggtttattctgacttgtggcttcaggctttatgtttttgctgctgcatttttttgtattctctttttgttgtctccatgtacaaggcatttcattcgtgccatgttttactttttttaactttagttttcaagaagaaatgtcaagtagctgtaaattaagacttttatggatgctctgttgttaaggtggatttaaggtgtttgaagtcttcctcttaacacttaaaagctgagaggttcacttcctggctctaatgtagtgactggggcagagtgattatggctggtaagatagctgggcgggcctgtttctgagcgtacagtaaactgaagataaaaggcaactattttgttcccaaaccaccaattaaacaaaatgctttaactactgacttaagctgcttccttcttgttttgaagttctgtttcttcctgtttaactcaagtaaatacacccagctgttggtctcaggggaggttattttttcaactaagtaattcattcacatgggttcaataaaaagatgtacagtgaaaagtctccctttcacccacacattttccatttgccctgtccctcaacttgtgttcttgagtcccttccggaatcactttgtgcaaatacaggcaatatgaataaatattcttctttctctcttattacacaaagcgtagcctaccgtacacattattctctcatgcctttttcctcctcacattttcatggaaatctttgcgtatctgtatacaggtataatttttttacaggtcattaaaatgtttcatcataaggatttctccaggtctaattaacccctattgatggatatttgctgttacaaataaactgtgatctcgtaaataacatcatttcacacatacgagtaggatacatttccagtagccctatgcatttgtttaaattttattatttttaattttcaataaatattaaaaaattgccttccatggatgttgtaccaatttacatttctacaagcaatgtttgagaatgcttgtttcaccccgaaaacattgtatatgtttttttgctaaatggatggggaaaaatgctatttcattatggtgaggccaggtgtctttccatcaaagagttacttgtatttcctgttctgtgatctctgttcaaatcctttgcccattttctgttggattgttggtcttttatatgttgattcccagacacctttttatatattgaggaggctaaccctttaacatgaattgcacataatttttccattttgtctttatttttttatgccattaaggtatgtttcgtcccacagaagttgttttttttttttcatgtggtcacatttatcaatctttcctttatggcttctggattctaagtaatagaaagtaaggtctttttacacgttgaaattttagaaattctcctgagtttttctagaactttcatatttagatttttcacactaaaatcttgaattcatttgcagtttatcctttatttttggtagattgctctccagttgtcccaatatcattgactgactagatcatcttttctccctggtttgagatgcccctttttaatcacacactaaattcaaggaaaacccaggaagcgctccttcccagaagcttcttcctgagatcacctactggtccgtcttcctgtgtccgtctccccaatgtgtccactgaagactgagatttctttctgcttaaggtgcccaacagctcctccccagagcatcctgcctgcaaaaaggaaccccacccagctgatccggagcagatgcagcccgcctggtgtggcagggcgtttccatcatctcccacgtcccacgcctgtcgagggaacggcagcgagggaattcaagtggggagcagagggcagcatcattgcttaaatatgactcacttggcccatttgcactcttggccagaactagggttagttttgagaatagttacagagaatgctgtttctccaggggttttggagaaccaatgattaggtgcaggccttgggccctcgggaggaaagctgaatgtttgtagtcttctctgctcaagacacgctagtgccttaaggatccagagagcaactttactcagtttcctttctccagttttgcaaggtattggatctcctatggcctcctcagttaggacacaaaatctatgtggattcaccagtgttctccttaattacagaagaacttcagcccccatactagtcgtttcagttgtagatgctgattgtcccccaaatctgactgtggtctagagacctggcctttcctctagcttggcaggggcaggtctggcggggctgaccacccaatgaaggaccgggttgtggggtggctgtggttagtgatgagttatcagtgatggtggctatggttagcttctgcggcagccccagttgggtcagtaagtgtttcgctgctggcttgtgtgggctgctgagaaggcaggaggtataactgggccttagggaagaccacaggcacaaagtccaatggcctggctgcctttcttactagtcctgggcaagtaagcatttgccttgggccagaggtatatattctccatattggggtttctccaaccataatgtgggtgttaatagtgcctctgtggattaaatgagatagtgcctgaaactgctcaagacagcactggcagctaggaggcagttggtaaaagtgagcagagacccagccctaaagatgcacaagctcagctgagaacactgccagaatgttcagctgcctagcagtaggtaagtcaagaagattgaattgggggtcatcagtgcagaacacaaacagatttggctgtttttttccaggttctccaaattggtctttggaacctccttctagggagactggagaaagctctggcactggtgtttgttgagtggatgggaggcagggttgttaacttttcttgccccttctttcctcttaggaatgtttttgactccagtctcggggccctgagccccctgtctcctactgcaggtcagagtgggagcattccagttcagttccactcctcatctggaattccccttggattcattttcaacccaacaggaagtgaaggcaagaatcaagaggatggttttcaagtatgtatgatcagatactgctgtggttagggtgacgccaactgctcttaaaattgctcccttgaagggtttggtcctgctctgggctcacagagaggactgtgggctgctttcaggagtccagctgggcacagttggtcacatgaattccattctcaaggctgcccctccttattgcatgataatgtcccaggtaggaatttaaatgcaagtaaaaaaattgctgctgtgatgtacagttgtcagttacctgggagaaagtgctattgaaggtcacgaatggggttaagagcctggaggaataggaggaacactgagtcttaatcccatttctgtcccttgtgaccactgcagcttggacagttcaccacacttctctgagcctcatttttgtggtctaaaaagagtaagtgcccccctgttattaagagtgctttaaaaattatgaatatctggttatgtgcttatacatatacacaccttatgtgttagtctgttcttgcattgctataaagaaatacctgaggctgggtaaattatgaagaaaacttttattggctcatggttgcgcaggctgtacaggaagcataatgccaacatctgctcctggtaagggcctcaggaagcttccaatcatggcggaaggcaaaggtgggggggcaggtgcatcacatggcgagagcaggagcaagagagaggaggaggtgacacacattttaaaacaaccagatcttatgtgaactcactcatcgccaatggatggtgctacgccattcaggagggatccgcccccatgatctagacaacttgtactaggccccacctccaacactggattacagttcaacatgagatttggaggggacaaacctccaaacaatatcgccctctaaatatatatatagtcatatgtttacttacattataagttagctgatgtgtacatctgaatatgatatgtgtgtttatgctcatatgtttttatacacttatattttgtgtatattttatatattatatatacatataatatatatgaatgtgatatgtaaatatatgcatatatacatatgcacatattgacacatacatgtatatacatacacacatatatataatgttcttcacaagccctcatagaataatgacttgatttgccccttgccactctggtctgtggatccactctgggctcctgctgccccttgtactagtgtccactgaagtcctctgaagtccatggtcacagccatttatggctgtctcctcccattgcaaaggctctgagctctgagggcctttttccagttgcaagcctctgtaggtctaccagtgctctcaagaagcctgaggccccacaatgggcacagcagggactctgggagccctgcaggcctcaagaatgtcctagtaaccctcactgacttttatcttagactctctatcccagccctttcctctgccgtcgaacagatcaagcggcaagtcatcatgcaagaaagtacaaaaggaaagagctcattaatatgtgtttataaaatacagtagtgcacatcggccttttcttcttcccctggagccttgtgcccttggggcctccgagaattggcttcttacagagaacagtctcagccttgctccgtatctttgactaagacacacagtgcaggggcttcctcccagatttgtggaatcactgtctgctcttggtatatttaggaatatgcgctttgtttttgaagcacagtctcactgtgttgcctaggctggagtgcagtggtgctatattggctcactgcaacctccacctcccaggctcaagccatcctcccacctcagcctcccaagtagctgggactgcaggcatgtgccaccacactgggctaatttttctatttttgtagagatggggtttccccatgttgcccaggctggtcttgaactgctgagctcaagcaatccacctgtcttgccctcccaaggtgctgggattacaggtgtgagccactgtgcccagccaggaatctcccccattttttttttttttttttttttttgtgagacgaagtctcactctgttgcccaggctggagtgcagtggcacgatctctgctcactgcaagctctgcctcctgggttcacaccatcctcctgcctcagcctcccgagtagctgggactacaggagcccgccaccacgcctggctaattttttgtattttttagtcgagatggggtttcactgtgttagccaggatggtcttgatctcctgaccttgtgatctgcccgccttggcttcccagagtgctgggattacaggtgtgagccaccgtgcctggccgaatctgcacttttaaaaggcgtctccccaccctcccctgtgactgttacacacgctaactttttaaaaacagctttatggagatatattttatatgccataaagttaacacatttaatgtgtacaattcaatagttttgaatatatttacagagttaagcaacttttaccctattctaatttttgaacatttttatcacctcacaaagaaaccttgtaagtagacattgttccaaagaagatagacaaatggccaataagtacacaaaaagattgtcaacatcattaactattaaggaaatgcagatcagaaccttagtgagctaccatgtcatagccactacgatggctcagagactgacaaaaacaagtgttggtaaagctgtggataaagtacagccctcatccattgcttgtgggatttgtaagtggtgcctgccacattggaaaaaggtttggcagttcctcaaaatgttaaacatagatttagcatatgacccagcaattccacttcaggagagttaaaaacacgtgcacacgaaaatagttgtatgctaatgttcataccagtgctgtttatagcagctccaaaacagaaacaacacaaaatatccaactaatgcatgtataaacaaaatgttgtatatccaaacaatggaatactattcaactgtaagaatgaacaaaatactgattcatggtacagcatggaggaatcttgaaaacattaggctaagtgaaagaagccaggcatagcaggtcatatactatatgattccacgttttcttttttttttttgagatggagtcttgctctgttgcccaggctggagtgcggtggtgctatctcggctcaatgcaagctccacctcctaggttcacaccattctcctgcctcagcctcccaagtagctgggactgtgggtgcccgccaccacgcccggctaattttttttgtatttttagtagagatggggtttcaccgttttagccaggatggtcactatctcctgacctcgtgatctgcctgccttggcctcccaaagtgctggaattacaggcgtgagccactgtgctcggccaacttttttttctttttttgagatggagtctcattctgtcgccctggctggagtgcaatggcacgatcttggctcactgtcacctccacctcccgggttcaagcgattctcctgcctcagcctcccgagtagctaggactataggcgctcgtcaccatgcctggctaatttttgtatttttagtagagacggggttttgccatgttggctaggctggtctcgaactcctgacctcaggtgatccacctgccttggcctcccaaagtgctgggattagaggcatgagtcaccatgcctggccatgattctactttttgtgaagtgtctagaataggcaaatacatgaagataaaaagtggattagtcattgccaggggctgacgggaatgaggaatggctgctaatggtacagggcttctttttggggtaaagaatagattttggacttagatagtggtgatggttgcacagctttgtgaatatactaaatatcactgaattgtacactttaaaagtgtgaattttatgttatgtaagttatcaataaggtagtttaaaaaaaaaatttacccattatatgcagtatgcattttcggaggaaaaggctgttggtttaagtttagggctaaaagtcaaagaccatttgagtgactttgactcaaagaattcacctctgctcttgtctgaaaaactaatcaaatctcaaagaattggtacaaaaaggagcaaggagcattagagatcatctggtatgttttccctcccttattttacagaggaggatattgaggctaagaagaaacaggggccctggccaggatcagtgggttacactgccaatccaataggccccacccagctgtcctttcccacctctcaccacgctccctctcccacaccccctagatgattagttgagctgcttttcagctgtgttgaggtcataactaagggcttgagagcattatttatgacatatgaaatggagagacacactaagattgaggacattgagggtggagaatgaagacttcttatgtgtctgaacaaggtctgctcttctggggctgtgtatgattagcacttatgtttcctaggacaactgtaagtgacaacaaacaaggaaaggaggcactgatttttggccccagttgtggggtcactgaggacactaaaaatgaagacaggctgttatgaatcagaatggaggaacatgggccaaatgggagtgatgacctccccggagcactttgttctttttctacagtgaagttttctttttaaattttcaacttttggccgggcgcggtggctcacgtctgtaatcccagcactttgggaggccgaggtgggcagatcacgaggtcgggatatcgagaccatcctggctaaaacggtgaaaccccatctctactaaaaatacaaaaaattagccgggcgtggtggcgggcgcctgtagtcccagctactcgggaggctgaggcaggagaatggcatgaacccaggaggcagagcttgcagtgagccgagatcgcgccactgcactccagcctgggtgacagagcaagactccgtctcaaagaaaaaaaaaaattaaactttgtaggtacgtagtaggtatatatatgtatggggtatgtgagatgttttgatacaagcatgcaatgagtaatcatcatgtcagggagaatggggtatccatcccctcgagtgacagtgaaatgttagatgcttgactgattaggacagctcaactcaaacccaggacacttgcctttccagaccgaggcagtcccccaaaagtatgttttgaggtagtgaagaaaccactctgacaaccaccttattgctaccttgcaagaagtttaaaaaacattgcagtcaaaccttccaacattgcaccccacgatgacataaaatcaagataagacctggctggtgattggttcctgaatgcacagagctcctggcctgctggctgcccgggcttgctcatttcattaatctcatagtaacacaaccctgtgtttactgtgactgaattttttggactccctccatagctttgtctccactttaccttggcagaaaacggttgatagccttccccggcccctttcaaaccacattaacgtttaaatatggcttttgggttagaattacaaagcattttgtccttttttttcccccttaatattatttggtatgtgcttttacataaagctgtattatttttcatgttgattgtttttaatgattatttaataatccaagttcaggtatcacaatatatttaattattctcctaaaaggtaacatttgattccagaatttttgtctattgctggaaaaaaaagctgtaatcaacatccctgtacctacagtgggttttcttttctttctttttcattttgagacggagtttcactcttgtcacccaggctggagtgcagtggtgcaatctcagctcactgcaacctccgcctcccaggttcaagtgattctcctgcctcagactctcccgagtagctgggattacaggcacccgccaccatgcccggctaatttttgtatttttagtagagatggggtttcaccatcttggccaggctggtcttgaactcctgacctcaggtgatccacccgcttcggcctcccaaagtgctgggattacagttgtgagccaccgcgccggctgggttttcttatgaattattattattgttatttttaagacagggtctttctctgtcacccaggctggaatgcagtggggcaatctcagctcactgcaacctctgcctacctggttcaagcgattctcctgcctcagcctcccgatagctgggattacaggcccccgccaccacacctggctaatttttttttttttttgtatttttagtagagatgaggtttcgccatgttagccaggctggtctcaaattcctgacctcaggtgatccacccacctcggccttccaaagtgctgagattacaggcatgagccacagtgcctggcttcttatgaattatttttcttagtccgtttcatggcctgctgacatcagaatgacctgcaggaaggtgagggaggaggggagggagtgctggtttgaaatctagattttcaggccaggttacagacccaccaatttggactgtcagggaataggacctgaaaatctacatcattaagtctcctgagagatttttatgaacactagaatttgagactagactcaaaagataaacttcttacagtaggctgctgtgggttcattttggtaacagccacccactaggtcctcagaggtgctagacccagtatttcatcctctaacaatactatttctttccccttttaacatggaaggaaactgggactcaggtcaagtaacttttccaagtttacctgctaagatatttcagaactaatatttgagcccctccacctctggaactcatgttcttaattacctgtctgcactgatagcaaaatgttttgattctagccctcccaccccccacccccaaaagttcatacatggcagtcataacccccaagacagtagctgatctgtgaaccttcaacttgcaacctagtttagttcaatttgagagaaattagaaaaattctggtgagactctggcctcagagccccctgtctgggttcaagtcctgccttcgccactcatgagtggcataaccttagtttagacccttctctggactctcctattccagagagctgtggtgagaattatatgggcatatgctaagcatatataggtaaacataggttgagcacagcgcctggcacacgctaagtgcccaggaaatattagcagttactgtcactattctctgagtggggtttcctcgtttgttaaacgtagaaatagaccctgagctcagaacagactcttaggcagaagtgcttcctggagtaagcggagggatttctttttcttttttcttttttttttttttgagacggagtctcgctctgtcgctgaggctggagtgcagtggcgcgatcttggctcactgcaagctccgcctcccaggttcacgccattctcctgcctcagcctcccgagtagctgggacgacaggcacccgccaccatgcctggctaatttttttgtatttttagtagcaacagggttttaccatgttagccaggatggtctcgatctcttgaccttgtgaaacgcccgcctcggccttccaaagtgctgggccttccaaagtgctgggattacaggcgtgagccaccgcgcccggccaagcggagggatttcttctcacttctcagaggtcaagccatggggaatctcaccttaccttggtcgcaagccagcagacagttttcttgtggtaacccttaacagggtgctgaggtagagagggtgacagcattggtatcactgtgctgagcaacgtgaagggtaagtaccgtcaggcctgtgcagtgggcagcctgggctctcatgtccctgaaacttaatttctctgtaaccacaggctgatggttgtgaagagagaggcccagacccattagaaaatctggatgggccaggcgtggtggcccacgcctgtaatcccagcgctttgggaggccagggcgggcagatcacctgaggtcaggagtttgagaccagcctggtcaacatggtgaaaccctgtctctactaaaaatacaaaaattagcagggcatggtggtgagtgcctgtagtcccagctactcgggaggctgaggcaggagaatcgcttaagcccaggtggtggaggttgcagtgagctgagagtatgccacaacactccagcctgggtgacagagtgagactctgtctcaaaaaaataagaaaacaaaatctggctggaacccaagccttcccctgaaggtggtagatggaaaggaaaaacagtttaattctgaaggggccaagggcagacccctgtgagaaacagaaaagagtatggggaacaagcactttttcttttcactcctgaagctgtgagcctgtaggagtgataatgatcagatggaccacaagggaggggaggctttggggaaagaaggcaaggactggtttagaacctcaggatccaagaacatagccaggaggccatagggctcactggccagtgggtagaggagcaggttgcttcaaagccaccgaagcaccttggctttggatgagaagaaagtcttgtgagcatttaagcaggacagtttagaacaggagttggcaaactttttcagtaaaagttgtatagtacataattttaattttcaggccagtggtctctgtgtagacagtacctaaatcagtgagtgtggctgttttccaataaaactttacaaaaatgggcagcaggccagattaagctgagccctggagaggaaagagtattggcttcaaattcagccagactgggcttaaactccagttccgacctccactagccagatgagagtcaggtgccttcacaactatgtaactatctgtttaagaacttgggctttggaagtggagggccctgggttcaagtcctgccttcaccactcatgagcggcataaccttagtttggccccttttctggactcctctattccagagagctgtggcgagaattatatgataatatgctaagcatatatagctaaacatgggttgagcacagcgtctggcacatgctaaatgcccaggaaatattaccagttatcactattctctgagtggggtttcctcatttgtcaaatgtgggtaagattagtaccttttaccatggatgtaaggattacattcagtaacaggtgtgtgtgtgtagtgtctggcacaaagtaaaatgtcagcgctaatattatcctttagaaatggaagccattctgccctcccaggagccctggaggaacactctttttaaacacaagagctctttggtgaaggaaacagtattagtagagatcagaatcgggttggtggtcttcggtatctaatgtgtgatccagcagggtgtgagaggagttgggggcgcttgggagtcagtggcgtgagtgtagtcttcctcttcggagattcatccatgttggtatgctctgtttttctttgataagcccattgcccaagccaagctctgctcgctagctccagaacacaggttacattgcttacctgtgtctttgctttaaccccttcctgtaatcagaatggcctcttcctttcctcatcagctgattcaccaagaccccatttaaaagctttttcccctctgaagcctgctccctgacagctccaccccacaatgaatctgctcctccgaattcctattatttgtatccttgcattcctttttccttgctgtcttgtagatcccatttcttcaactagactgggagttctttaagggatgggatcgtggttatacttcctggtctccatttcactatcttccctctagtggatccacagtaaatactcacaggttgaaaaaaaagtaagtaaatttttaacccatgcaaatgtcaatatatgtattgtaggcaagactgctaattctaggagttgtcagctcttgttgacactttttaactttatggagcaccgcaaagaaaactgccatttaagagcttgcttaagttagaaagcaataaaagtgaagaatattctaggcctggtccataaatccttcccaagcacaatcttcatgctctttccttgtcttcctgctgaatggagagcattttgaggactgaggggaaggtggaaccataacatgaaaggagcctggattcctgagtagctgcttggaggggagccaaccaggagagatgcctgggcaggaggactcatgtcagacttgcatgagaagtaaaaacacacacacacacacacacacacacacacacacagcaggtaatgcccatgcgtcttgtcagttggatgttttctcattagaaaaatgactatagttagggctgaattaaaggtaggcattgccttaatttatggttggtacaatctgagtgtaaatgtgtcccccatctagaatctgtggttagtcactatttcagaataatgctcccacagggttttctctgtgtgtactgttgataaccacagtaattccatcagcctcacattgttgatcatgtttggatgggctaccatccgctgaatggtttggctgcaacagggactgactcacaattccgtaacctaaaatccactgtagtgagtcattattttctgtccagctgacactcaaagctggcagtcctctctctgacaggacgcttacaggagcctcctaatttgagatttagcagagatcctgctctgggattccaggattggtcaacagttcctataactgagctgtgaggatgagaggatctcaagccacagcaaatagaggaccattggcatcccgatgagatgggacccctgtaacctgccctgatctggaggtggtcagacagctcagccttccagctcccaaccctgaatttggacatggcccacaaaggcctggatcacagaaaagactgtcatcacacccttgccttgaagccctgtccttcactcttatgggtccttcctcacacagttttcctaagctcattatctgctttcccaacccaggatgttgagctgtaacaagaagatgatgcagggatgaggagatgggaggcaggtgttagacaaatgacaagagctgtcggcccagagtcatcactcggggaggagaaaaacacacccaacacacaatgacattatgatagaatacaacagagatgtacggggtgaatctcaagtgcatggaaaaaataatttctgttcattgttgttgtggtttagatggtagaactatcactttcagcctctgctaggagaaagctacctttcgctaataacggaagagctcatcgatttcagactctcatcccaacttcacctccccacatcattcacttttctttcttttttccttctgggtgtgcacagaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtaagagcctcagtcaccctggatcagccctcaggtggtcagcctggggatcgtgacatggccatgggagggaagggaggggactggaagagccgtccaggtccttccctggatctgtcttttcctcactttgccattttgactccagtgcacaggaagctccaatcttttggagcctgtatttgcattgattttggttttgtttgaaaactcagttgcaagtgccagaaactctgctgaaatttatttgggcaaaaatggaaattcatggagtgatctcattcactgggtgggatgggggtccctcagggtgtgcaggagccagggacttcagtgtcatcgagattcttccacatatctctgctgttctctgcctgttgcctcctctcgtaccctgactttattaggaagctggaactggagctgtggacggtgcccagctcacgtcttcagagctccaccctggagagaaaagacccctttccacagtttaacaatccaataaaatattctaatcagcctgaggcagagcccactcttggggccaagggagtaggagtctgactggccactccccctttaccccatttgtctagctgctgggcaaataggctttcctagaagagaggagggtacagatccttaatgctctcaaaccaaaaaatggacgtcacttatgccatggaccaatagttattgtgagcgttaagtgaaatgactctggtctgggcactgtgtttgcacacagaaatctcttcattaattttagtacattatttaatttctcagttaataaatccagggttgtctttctcatgctgggcattattctaggtgcttagaatacagagacaataatacaaagtccctgccctcatggagtttccattctcagaaaggaactagataataaataaatacataatataatttcaggtggaagtaaaatgcaaaagggaaaaataaagtagggtaagaggctaaagaatgatggggaatagagaggaaagctattttagtttgggtggtcagtcaaggcttctttgagaaattgatttttgagcagaaacttgagtgaagtgaggagtaagccttccaaatatcaggggaaggcagggcaaagcaggcaggtgggtggtaagtacaaaggccctggggcagcaggtaggctggcgagttataggaaggaacagccagacggccagggaggggcggaagcccagcaagcaagtggcagaaacacaagaagtaagggtggaagagccaggagtcagccacagagacttggtgggcatggagaagatgttagtttattgtgagtaggatgacagacagcctttggagggttttaagcaggggaatgatatcttcagagaatcacattggctgctgtgtacgaaatagactgacaggataggggtgggagaggaaatagtaaggggagaggggaaactgattaggaggcctttggcatggctcacaaaagagatcatggtggctcctagagggaagcagctgcagcctcgacttaggatatgtttgttgtttgttgttgtttttgagacagcctcgctttgtcacccaggctggagtgcagtggcgccatctcagctcactgcaacctccgcctcctgggttcaagcgattctcatgcttcagccttctgagtagctgggattatatgtgcataccaccacacctgtgcacgccaccacacctggctacttttttttttttttaaatagagatagggtttcaccatgttggccaggctagtcttgaactcctggcttcaagtgacccacccgtctcagccttccatagtgctgggattacaggcgtgagccactgcgcctggcgttggcttaggatatgttttgaaggcagagcagtgagcggccgccactgaattggaggtgggtgtgtgagagaagaattgaggattttgacttgagccccagagtgaatagtggtgccatctcccgacatgggaaagatgacaacgggggaagagcacgggacattgtgttctgtttcagacagaggaagtttgcggtgcacattgtacagctcagtgtgggagccgagcagacagttgggtgtgagaatctggagcatggaggaggggacaggcatggagattgaaatttgaggtggtttttaaatctgatataaggtcacctaggtagtggggacagggagagaagatgaccaacgggccagcaagtgcaggtcagagagaggaagaagatagagtgatggagactaaagagcggccagtaaggtggggacatccaggattgtgccatgtcctggaaatggtgatgacatcattgtcatcaatcattgtgatcagcaagttggcatttaacacagcctgccttagccttcattggctcattttgtcttctcaaatataggcaatacaaactcctggagagaggagagagggactttgcctcatggccctctgcccgccgtttcccacattgtgccagacacagtgccttgagcatagccattgccaaagatttgtccatgagggtagaacccaccacacggtgggaatccctgtctccttccagtgctttcttcttcagcaggtagctggaacagtgcctctcaaactggaccagtattttgtttttttggttttttttcccccagatacaccatggactgataactttttaaaaatacaataaaaatgaggccgggcatggtggctcacgcctgtaatcccagcactttgggaggccaaggatggtggattacttgaggtcaggagtttgaaaccagcctggcaaacaggatgaaaccctatctctactaacaatataaaaattagccaggcatggtggtgggtgcctgtaatcccagctacccaggaggctagggcaagagagtcacttgaacccaggaagcagaggttacagtgagccgagattacgccactgcagtccagcctgggtgacagagggtgactccgtctcataaaacaaaaataaattaattaggggaaaaatgaaataaacacaatataaattcaaatgtttattatttgattcagcagacataaaatgactgtctcatcgctgtccagttagtttgtcagtgtttcagtgtctgcgcttgtcccctctgcaccagcgtttaatgcttagggagctgctctgcccacccattgctctttgagcagccatggcctagagagatgagaagccattccttgggagggggatggcctgagctgagggccatgtagggctcccaggaccacctgacccacccctccccactcccaccaaagggctgagtcgctgttgctcactggttctcaacgtgtgctccctggatgcagtatcttcgtcacctgggagcctgctggaaacgcacagcctgtggccccacaccactgaatcagaaactcagagtcagagagccttggtctgctcttcatcctgccttcagtgactctgatgcccaccagagtttgagggtcactgccaagggcagcgtgaaactctacaagcaataaagcaaaaaaactgatactggttcagtctctacttttatttttttgagacagggtcccgctctgtcacccaggctggaatgcagtggcacgatcatggctaactgcagccctgacctcctgggctcaagtgatcctcccacctcagccacccaagtagctgaagtagctgggaatacagatgtctgccacgacacccagcaattttttttttttttttttttttttttgtagagacagggtttcactgtgttgcccaggctggtctcaaactcctaagcttgagggattctcccgcctcggcctcccaaagtactgggataacaggcgtgagccactgcacctggtctctttccgccttttgagccccttctctgacagttctcagctctggctcagcatctgaattacctggcagcttgtaagaaagtccattgcagggctggggggctccagggctggcagcactgcctgcagaccgtggctgtgcaacgcctcccctgtgcacatgtgccctcagggctcagtcctgggtcctgggaggagaatctgttttatgtgcattcagaggagaatgggaagttttacagacctgaattttagaaatgaatgggatttttgccctatcgtcaaaccttggtccaccctgatgacttttcaaggacaggattcttctagatacattactgactgcacgtcttttttttttttttttttttttttttttttctggagacagactctcactctgttgcccaggctggattgcagtggcacaatctcggctcactgcatcctccacctcccaggttcaagtggctctcctgtctcagcctcccaagtagctggaactacaggcacccaccaccacacccagctaatttttgtatttttagtagagatggggtttcatcatgttagctaggctggtcccaaactcctgacctcaagtgatccacccacctcggcctcccaaagtgctgggattaggcgtgagccaccacaccccccctccgactgtgtgtcttcttaaaatgaggtttctcaacatcgcctaaccctttcttcatgtcctagtgtcaccatctgtacatcattttcctcctggcacaaacagcgctgccctatggctatcgaggtgtgctggccgcttcctctagatggcctcctattgctggccttggagttcttacgtccattgtttatcattcctcagtctttttttctgttaccagctatgcttgcttgttctttgcttgctgtcacctcgaaccactttctttcatttccattccggttaactgttttcctcaccagctatgggtctgacaaaaccagacactaaatctgtgctgccatccacaaggaacccacggcctagaagatgagggggcaggaggagggtgggtataggaccacaagctgttacaaccccttggcacaggtgggaggagctgcatgcactggccagcgagcctagagggcagcacgtgctgttggctgagcaggtggaggatgccaccaacggcctcttcagcaccctcagcagctcggccatctgctccagcgccacgccaggtaagatcttccagcctggagggagtggaagtgccatgtggggtcggggagggctccctgaggcaagaggtcaggacccaggagcctcccaaggatggagggcaggcaagagaaacagagaccggcagcctccaccctggatgctctgcgtctccctgtgccctgccctgtgggtttcccagctgggagccccgagcttgtcttcatggaggtagaggggcccagggtttgagacccaaatgtagtaggttccctgtcccctgctcaagagacagagccaagtctcctccccctgccttggaccacacagaggagcacaaggaggctttgtgcttggtgcgagatccctgcattctagtcgtccttgtcagggtccacccaggagccacattgatgacgttatgtggaatgtacatgtgtgcccattacgcaaaagctgtgtggggtggggcccagcagaggagatgctcagagactggatgccccgctgaacaggcagagcagggcccttcacccagagatatgccctgacctgagagagcagaaagtggccagcctggaagtgtggtggaacctcccaggagcgggagcagctgctggggaagcgtgtgtggcaggaggaggtggaaccctgtctcctccgtgggtgtgggtgtgtgttgtggacacagactgcagggtcgaggctcacccctgtgagcacaggacgctggagatggtccgggagttcgctggcaatgccccatgctggagaggatcgcggcggacccttgcggtgctggctgcacactgtcccttctacaggtttgtctgcgcggtctgggctcggcctgggtggagatgaaggcccccacccctgagctgcggggaggatagtactttggggccctgccatggagattgtgacagggatcgaaggagacctgggagggagccagggacgtagccatgggagaacagggagaggcacagctactcagtgtcagcatcccttaacacacagcccaggtacccagggtgagcactggtggcagggtcacaggcattctggaaggctggtgagtgagccaagtgctggccctgcagggcggtggtctgcacttgggatattgatttggtaatttggttcctctgagcaccagtttccacattatgggggctgagtgaggcaagaggatagagatcctcagatgaattccagtcagggaggctatgggatgctgggttctttgggattggagcccaggcacccaagagcacctgctgcccgtctgcccacccatccctcccaaacactccccacactgttcctgggcactttctttagactacctgccattcagcacctctgtccggagactggtgaccctgcccctctccctttctggggggccggggcagtgtttgaatcagctgcatctttacccattggtcctcccccagcgatgagctcacagcacagcacacagcagtgaaatggattggctgagaagccttagggctgtgctgggctgatggagaatccaaagactgtttctctgggaaaggccagccccctacataagggtcagaggagatgaggtctcatgccactctggggccaccagaggctctcctcagaacccaacctctcaagtgaaaggaggagttgattcgttccttggtggccactttctaagtgcctgctcagagccaggcaatgtgcaataagaagacagtacagttgctgcccccaaggaatcatggtttagaggagggcattggaaaaggagaccagcggccaccctgaggcatcctaggtgttgggatggagtctgtcctctctgggatgtcacagagaaggggctgctcgagcagttttgcaagatttggaactgtggcagtgggcaaggcgctcagagccgggagcggctggaagaggctggtggctgcagtgtatacttcctgggccttgcattcagactctgctctcaggctgctgaatttttaatcttagcagaaccactagggagcggtgaacttaccactgcatgtttctatgtttgaaaaggggtgtgataataatcatacctgccctacaggtttgttgagaacaggcggtgatttaataggtagatgtgttaatattgcaggctcctagaatgaagcatttgggagctcttcacccatttcttcactcaagaaatacccactgagggcctcctgtgctcctggcactcacccaggtcctgggaaatcagcaccagcatctcagaaacacatctaccctcacaagctgacgctccagtaatgggaggcagtcattccaaaatgaatacagaaaataaactgttcagtggtagcaggtgctgtggaggaacacagcagcaagatggggatgcggtggggtaggcggggggttggggcaaggtcacagtttgaaatggagtggccagggagggccttgcagagcatgtggcatttgtgtccagacctgagggaggtggggggcaaactgtgtgcaggtccctgcaaagccctgttggtagtgtctgctccataaatgctgattcccagggaagcctaaatcagggagggggaagggcccagggatctttctgggctaggacttgtggctttatgaggtcactaggatagacatggaagagaagacgatttctcttgaatgagctggcagtttggcaaactttgtttttattattatttttttgagacaaggtcttgctctgtcaccaggatggagtacagtggcagaatcatggcttggtgcagcctcaaacttccaggctcaagtgatcctcccatttcagcctcctaagtagttgggactacagacacgcaccaccgtggccggctaatttttaagatttttttttatagatggggtctcactatgttgcccgggctggtcttaaactcctgagctcaattcctgcctccgcctttcatagtgctgggattacaggcgtgagctaccacgcccagccttggcaacctttatttcagcaactccatgagctctgaattgacttggcgtgtactccattttaccccagggaagaccctgccctagaggagcacctgattggcctgcccctgtgtgggcagcccagggtgggatcttgttggaagaagccttatttggagaactttagggaatgtttctgccaaggcccaagagtctcctcaggtgaggccatcccaggagctgctgccaacccagagtggggctttctgcccccagatgaggaaccgctcctgtgacagcagggcacatggccccggagacgcaggagaggcgagggtgaggcccacagggtagagtggggggatttggagtcatggtcagggtttggatcccagctctgctgtgttccggtaattatgtgacctcaggggccctaagtgagccctcagaacccatttccctatctggaacatggagggaaccatctcttcaggtagctgtggttcatggaacaccagcaggtggaagccacccaaggaatggtggctgctgtgttatcacagaacgttagttctccagcagacctgagaagtcattgagtccagtggcttacatgtcttgacctgcagagcctcgtgtggacacttgttgtgtggaccagatagtagcagcacacctggggtggaggggcggggctggggcactgcgggaggcctggagccttgctccttcagtgctcttctctccccatcgaagctttaaggaatacagttgaaaagtgaagatagaattactatacaaagaggaaagtgaagaccagaggaggaaagtaacatgtctgtggtcacacagccaaaatccagttgcccagttcccaatatttctctccctactgcatcgtaagcctcagaaagtaacttataataaaaagctgttgctacagtttggggttttgcatgtggatgtccctaatttcaaatgtgatagccagcttatgttaccttttttttttgagatggagtcttactctgttacccaggctggagtgcagttgtgcaatctcggctcaccgcaacctctgcctcctgggttcaagcatttctgcctcagcctgctaagctgggattacaggcacatgccaccacgcccagctaatttttgtatttttagtagagacggggcttcaccatgtaggccaggctagtctcaaactcctgacctcaagtgatttgcctaccttggcctcccaaagtgttgggattgcaggcgtgagccaccactcccagcctattttttttaattgtcactggatagtttgaaacattccctactctatgtgcagagaaaagttagggtagaatcaagaaacaaaaccaggaagtctttcttacttctgcattggaatcttctatcagcttttggtgttgtaaatcatcttctgttttctgccctccccttacacctctgatctgtctataattctgtttccttggattgtagctggaagagagtgttcctaacccaccctgccacctgctacaggaccacctgcccaggtatggtctgtctcttggatttacaggttctttcagggccctgggcccaggctgctttgtaaagtggcttttacaatcctgggacagagggtggggttgtgactggctccagggcagagggatggggcacttggggggcagaggagagtgtgctcttgactccctcaatggtgtttgctcattaagaatggagtggcggctttgggattactcccctgaaccagtgttgtgtgcattggtgagaggcagagaggcaggcaccgagcaccagctttgcagacatcctcaaagccagcaccaaactcagggcaagatatctgagtgatttcctcctctataaaacatagtggtttgtccgatgtctggaagcccatttccctcctccatgtgaaagggggtcatcgtatatgaggtcctagtgaagattcagtagataatgcccatggaagtaatccctcagctgtaaaatcccaaattaacgtgaggaatcatcgatgccattatgcatcattcagcatggttcaccagtgtgccctcactatccctcacttggggtgctagtgaccccactgacctgggagcttgaaattgcccttcaatgtgtaggtgtcagtcctggggtggatttgttactcccgatgagtagcctgtctcccggaagcaatgccggcagttagacacacaggcagggcagcgagcagttagacacacaggcaggcagggcagcgagcagttagacacacaggcagggtagcgagcagttagacacacaggcagggtagcgagcagttagacacacaggcagggtagcgagcagttagacacacaggcagggtagcgagtgtccctatttggggttaggtgatcccttcagtatgttcacaaggtttacagttccagcaccacggcctctgaagcacaggagaatctgagagtggagctgtttctgctcagaaattagggtttgaggacttccggtttggaaactagagtgaaatggctttcagtcccagctttgcctcttaccaatgatctgacctggggcatgtgacttctattcattgagcttcagcttcctcatctgtcatatagggtttttatagttcctacctaaggttgtgacaatgaaatgggaccatgcgtgtattgtgcttagcacagtccctggcacataatagatgctcagttaaaggccactgtcgtcgatctcagtgagcccccagctatttccacagtcttctggctgatacaacagcagccccagcgaagtgcctagacttagcctcaatcttttctgcctttgaaaagtctatattttaattacaatgatgtggccatcaagaaagagattaatatttgtaagcaaaaaggacaagaaaatgccagtcccagttgtgaccacactcagctgcttatccagctcttggaatacatgatcacatgaagaccttgtttgttttctgtaaccctgggaaggaggtcatgtggttttagctgcactttgtaataattgataaggaaagcaatgagatgctcaggcatggaccacagggaatcatagatcagacgcttcagaatgggccacattttgacacaggctgtggtttcccatgtaaactttcagctttgaagaggccttgctcataatttgcatctcacatccaaaagtcaatactgtcattacctgttggggagtgtttttttagtgctgagactttctgcggattaattcatttaatcctcacaataaccccacagaacaagttcagttcccatcactcctttttagatgaggatatgaagatgggagaggttaattaaggtgccggaggaagtggaagaggccacattcagtcctgagcagcctgactgcaggatccgaaggctggtgtgttttgctgtgccaggtgcagaggccattaagacaaccctgtgtagaacttagaagacagggccccattggcaccgcagctctctctcagtcttgaggcacccacacttgatgctacggggagcttcctccttgtcaagcttcagtctaacaccagttcatcacacagggccttaccaagcctgctacagagcatcctttaccacccgtgcccagcccctcctttatgaactccacagtgctttcccctctctgctgcagatttcctggtggactgtgggggaagggaggggctgggccactgctagagcaggaagccagctgcacccacacctctggccagtcctctccactcctctgtgctgcggtgcttagcggttaatgggcatctctctgataggcccctgtgactcgcagccctgccagaatggaggcacatgtgttccagaaggactggacggctaccagtgcctctgcccgctggcctttggaggggaggctaactgtggtaggtatgcaccggccctgcaagactgaccactggggagcaagaagaggacgggctccccttttcattgcacgcccttccagctgctgggtagaaactggcccttgaaccatctgctttccaatgcaccactggtctgcagttcacgtggtgcagcctgtcagtgctccgtgagtagataattggggtggctgagctctggatgagacagtggctcccagcttattagctgcagaatggtcactgcttgaagtttgagtgctgcccagcccagctgaaggcaggagtccacccaactctggctcccagtcctgggcagagtcttttcttctctattctatgaaagcagagcaaggagccccgattccttttgattttagaggtgtgaaatgaagatgatagtaggctttacctcactgggtggttgagagttttaaataagattatgcaaagtgcttagtaccatgcttgacgcatataagggcttgatgaataataacttttaaaaacaagtgatactgggttagttgaagatctgtatgaaaacaatcttgaccctgtacctcacaaccctaccagaagtcaattctagcgtggctatagacctctgtgcaaaaggcaaagcagtgaagcctgtagaagcaaacacaggagcatatattttcatgatcttgaggcagacaaagatttctcaggacacacacaggactaaccataatggaaaaaagtgataatgtagatggcatttttctttaaaaagtggctagatggagacccttagcgagtgccaggagtgccatgtctggccttgtctctaactctgtgacgagcacgggtcacttaagcttggggggcccacagtttctctgcaccatctccctcctgggagatgttcggcatctcgggtgggacagctcgcatgccgcatgaccatggcttgacagtgggtgttgctgtgatccccgcagccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccaggtaaggtcccagtgcctgacccaggaccgctggtcagtgggcgggtccttcctccttttggccaccacctaaccatcattttctgccagtgcctcttctaggggctgaaaccacagccccactctttcaggcaccagtcacataaataattttcagtttacctgtcaacaaaatgggactaatagtagtacctcctgagagatctttagtgagaattaggtaagatgggcagtgtacatgcttagtacagagtaagcactcagcaaactctaggtgttgctgttatcattcttaatcacgattttattgttgttgttactaagagctctgaatctactaagcaggctccagagcagcagcttcccagctcctttgatggcaatccacagaaaagtgtgttcctggtgcacacatgcacatgtatgcacacatacacacacggatgcatgtgcatgcacacgcgctggtgcagccacacacaactgaaacaaacgcttcctgagaggatacttaccctgtctacttgggatgcattctgacatttttctcttctgttctgttttgcaagccatgaagctgattttttatgacccctattggaaggcactctagagaacactgtccccacgcagaggcctggcccatggccagagatgtagtagctgaaacacgtcttttttttcttttgagacagggtcttgctctgttacccaggctggaatgcagtggcacgatcatagctcactgcagccttgaactcctgggctcacgtgatccttccacctcagcctccagaatagccaggactacaggtgcacaccaccatgcccagctaattgttttattttttagagagatgtggtcttgctatgttgcccaggctggtctcgaactcctgggctcaagcaatccacccacctcagcctcccaaagtggagggattacaggcttgagtgaaatgtaagcctttatagggctcctggagttctccccttggtaggtgggcatgggaagctacagatgtgattctgcttctcagccctgatgccaccactctccccaaggcgagaggctttccctcctgtaaggcggaaggacagggattggctgcccactcccaccctgcccctccaggctggtctaagtgcttttgttctgctgctttgtttggttggattttttaaaaaaaataatagttgtagatttataggaaaaaataattgacaatagtggagagttccctataccccacacccagtttcccctcctattaacaccttgcattagtatggcacagtgttatcattaatgaaccagtattgatacatcattatttagtgaatccatgcttatttatatttgtttagtttttacctaatgtcttttttgtgttccagaatcccatccaggaccccacagtacatgtagtcagccgccttccccgtagctgtgatagtttctcagacgttcctggtgtgggagtggttttaaaaaccagtaatcagagcatcagctcctctaactccatacttagaatttccagtggttcccctttgcacttggaataaaacccaaactccttcccctggcttctgagagctccctgtggcctggtccccacaggcctctctgcatcccctgcacaggagaggccttctggctcatacttacttgtctttcagttcttaggtgaaatgtcacctccccagagaagctctgaccccttctcccagtcttgttatgttcccctactggtctctctcgaagtcccctgcttttccctccacgctgccgacatcatttgtaattctatgttcatttcatgtctgttcccctagactgtcagcctgttgacagcaggcatgggcccattttgtccatacagcatctaattagtgccctgcatactggggatggatgaaggcacaggtgaagatgttgtcacaaagggttgcccacaaacccaaaccccatgggttacataagacaggaacttatttctctcacatacagttcagaggtgagtggcccgggccagcagggcttggtcatcttatggcttccaccttgaggtccaaggtcaccatttctcagccagcaggaagggggagaggggaagtggaaggtaagcagcttccagctgcatgagtttgaaattgatcacgtccgtcagatagaacttagacacgtggccaccctagctgccaggaagtctgggaaatgtggtctggcaggcactcatcttcctgctaatattctaggaaagtgctgttctgtggctaaaaggaagacatagagggtgtattctgcagtgaacagagcaccctggctgaccttggtcctacccaacctggcagtccctgggtcccgtcgaggggctctgactggcacatccactgctgaagcccctctgcttgctcctgcagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggaggtgagtgggggaatccacaccctcagggctgcccccatggcaggccctcagcctgagccttcacatacatcatgacgaggatggcagctcttcccagctactgagcacttgcttcccaagtgccaggttctgtgctaaaccccatgctcacataaaatcctacagtaggcataaccatcctatttgacatttaaggtacagaaagtttaactaacatagataactccccccaaacttgagaatttatgcattccctttaaacagaacacacttttagaatatccacaagcttcctaagggtctaaagatcccacattcacactgacttgggcagtgacagagcccagagcaaacagggccaggccagcccaaatccagtgacctcctcttcaccttcttaaaagagacaggagaatcacttgaacccgggaggtggaggttgtggtgagccaagatcgcgccattgtactccagcctgggcaacaagagcaagattctgcctcaaaaaaaaaaaaaaaaaagtctgccatgtgtatggcacgtctgagcaatggactctccatgagtctgtaggagagctgggtcttactaacctagccaagtggtatgcagcaccaaccatgagctaccggggcaaagggagacatgactctagtagccttgcacctctactgggcttacttagggtaggggtcttcgggtctaacccatgcctggccggcctggtgggtatggtgttctccattgtagaagccaagcagccagtcaacctctgcaaacccagcccgtgcatgaatgagggcagctgcgtcctgcagaatgggagctaccgctgcaagtgtcgggatggctgggagggcccccactgcgagaaccgtgagtggagctcttgctctgtatgtgtgagccagggatggtattgcgagtcctgccaagtcccacaaactcagctgaaggcaggttctaaaacattcgttcagtggaagaaattattcagtcgtttacccacgaaacatttagtgagtacctcctgcatcccaggcattgttctcagtgcaggaacatagcagtaaacaaatgaataaaacctctgccctcatggagcttccattctaatgggaagacagacaataagcaaataatacaacatgtggtgtggtagacggtgctaagcaccccggagaaagtcatgacaactaggagggaggccacagttaggagcacagtagatccagggtacagggatgtagacggaggcagggatgggtaaatgcggtggtgggagctgctggaagctctttttggggtgctatttgctcagtaaaatgggaggaacagctaagtgaggacgaggaggaggtgctagaggtttgagagaaaagaagtcattgtcaagggtaacagattaggacctagagagtgatcgttgggaggcattagaggtccaactatggctcctgttcatgagtttgaagttagaacagccagaaatcagaagacaagtccagtcggagccttggttttttggccacgggcagaggttggcttcctaaggccagagagaagctctggaggataatcacatggggtctctaatctggcatcttctgctgggggcgaggtgggttgtagagtaagagcaggacctgaaggggtcctcagaggctgctggagggctgagaaggggatgcagacactcctgtcctcagacttcacttccttccccaggattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgtacctgctgtgccttgttgaggctatgtcatctgccacctttcccttgaggataaacaaggggtcctgaagacttaaatttagcggcctgacgttcctttgcacacaatcaatgctcgccagaatgttgttgacacagtaatgcccagcagaggcctttactagagcatcctttggacggcgaaggccacggcctttcaagatggaaagcagcagcttttccacttccccagagacattctggatgcatttgcattgagtctgaaagggggcttgagggacgtttgtgacttctggcgactgccttttgtgtgtggaagagacttggaaaggtctcagactgaaatgtgaccaattaaccagcttgtttgatgatgggggaggggctgagtgtgcaatgggcccaggtctggaggggccacgtaaaatcgttctgagtcgtgagcagtgtccacctgaagggtcttcctttcaaaagaggctgcggccagagactgtggctcatgcctgtaatcccagcactttggaggctgaggcaggtggatcacccgaggtcaggagtttgagaccagcctggccaacgtggtgaaagtttgtctttactaaaaatacaaaaggtagccgggggtggtggtggatgcctataatcccagctactcgggaggctgagacaggagaatggcttgaacctgggaggcggaagttacagtgagccgagatctcaccactgcactccagcctgggcaacaagagtaaaaatctgtctcaaaaagaaaaaaatgtacttaggaggggttaattgtggcgtgtttatggaattctttccttattctccttttagtggggcaaagagaagtaagattcttaaactcaaaaatataggataaagaaacttacagagattttgctttttaaagcattgatcttacgctgtctaggttttaattttgttttgctttgcttttctacacagtttttaaagaaatatttcaagaaatgttggttatttattaaacagggatatttgtacctatgtggcaaagaggcatatttggaatattctctggcaaactagatacttacttccctatcgctgcagtatttaggaattacttcttctccttggttgtgttgtttagagttggattttctgtagaaatctttctagagctctgatgtgactccagacactttatcgtttttcttttttttgagacggagttttgctcttgttgcccaggctagagtgcagtggtacaatcttggctcactgcaacctttgcctcccaggttgaagtgattctcatgcctcagcctcttgagtagctgggattagaggcaggtgccaccatgcctagctaatttttgtatttttagttagagacagggtttcaccatgttggccaggctagtctcgaacttctgacctcaggtgatccccctgccttggcctcccaaagttctgggattacaggggtgaaccactgtgcctggcccatttttctttataaatattgtaacataatgttttatagacaaacattcaagggtactttggctttaagaacttcaggatttctggtgctagaaaagcgcttgaagcagtatcaccaagattttagatattaaaaagtctggtgtaccagacattgagtcataatcatctatattcaagggatactttcattgataactttgttattatgctgcccttcacagaagacaacgtccggggcaggatcacatgctccctagcagatgctgatcagtgatgtcatagaaattacatgaatgcattgtctttaaatagcagtttaaccatgttataatgtaggctttttgtcttgttccgggctggtatttgggtgccctgattgaattacttggatttaaacagcaaactgtgggctctcgacttacatagtaagggcctttactgtttctttgtaggaaatgggtttctcgcctttgaaacattttttccccttttgtagtgacagtgccactaaatagttcagcttttgtcagtcccccaggaaagtgctatcctatggcctaactagccaagccttttttctttcatttaaaagaaattagctttaatttttacctttaattacttattcaaataagacagaaatatattttccttgcaataattaaaacattgcatataggccataaatttccttattttctctgaacgatcctgattccagtcatcttgttgaataccctagttctaataattgactcttgcttttctagagaaatatttccaaatgatgctagttttgtctcttcctttcaaagttgtataccacttctttttcttgtcattttgcattgcctgggacctccagaataatgtttcatgaagtagcatgtatccatatctggttcttgactttttcatcataataattgttttctatgggttacttatcagtttaagaatgcttaattcctagatgaactaagagtgtttattacatgttgagatttatggtatgctttttcttcctcaagataatgcattttttgtattatctgttaatgtgataggttatccatttgtgtattttcaatcattgaacaacccttgatttttttggataaactctatttggtcattatgcatcattctataaaccctgctgaatttttcatttgccaacatcttatttcagattcttttaatctgtgtccaacaatgagatttgttttcttttgcaatttgttttgaatttttggtatcagagctatactaaccttataatggaaaatacatatttctcaaacttttacactgatatattcatagtatttttttataatttgaaaaatcttgtcagtatctgtattaaggcctccatttcagttctgctatttcatattgccttaggttgtctatttgtctctttaatgaacccgattttgattttgtcatttttaaaataaacacatttatgctataaacttccttaatt

SEQ ID NO: 284 - DNA, 228336 bp, Homo sapiens
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacaggtatgttagctggaaggcgaggtctgggacgcgagcgggttcgggtttaccgctgcagtttccgagttgaattcgcttatttcaaagcatgttaactttcagaatggaaaaagggtgtgttgcggggggggggggggaggaaataatgttttattctggaaaggattcttaaaatacaggaagccttttaaaaatgcagaagcaagtagcttttgtcattgaatagaaatcaaatagcccgctaatcacatggcactttttaaggactgtatatgcaatagatgagttcgcagaagaatgaggtgaatcatttgtggttgaatagattgactactcccgcttttggcatcctctgatatgtgtctttttggtgccatttatctgtttgctgttataatgatgcctacccaaaaataacatacagcctttagaatgagaggatacatctatgagttttaatcagtgtggtttcgttattgaaaatcgagaggaaaaatctgagattttatcgttacaagacatgagctttgcaaatgagagtaatttagatgaaaagacagcagtataggtgaatataatattttacagattaattcaatgttctttgtatttgttgcataattaggagactgttttaacagtttaaactttaaacttggtaattcctggaaagatgccaaaagcatttccattttttcaccataggtttacatatttttgttttttttttaaaagggattgaaatcattagcaaatgagtttacatctttatatagtattggaaaagctacctgttgtacatcaccaagaaacttaataagtatagttactattattgagcatttatgaagtgcaaaacattttacacatactgtctcagatcctcacaagaacggtgtttggctggtgccattaacctctagagatgagaaatctaggcatatagaggtaacacagcttcacatgtctagttaagtggtagttctgggatttgattagatttttgagttttcagtgctgtgttctgcacgactaactggtaagtatagtggttttaagtaggagagtaagagcgtacaccctaggttttctgaatttttggattagtgatatgctttacactgggagccaatatgttggagacaaaagtttcttgtccttaatgcatttgatgcattcttctctcttcttttctgttctcttccttcacttcttgtctgtcttctcttcgaaataatctccaagctactacattggttttatgacgtgttgaacactgatctgtaatgttccaatgacacaatactttgcttcttgatttggcttcagaggccacttctgtggtcaaccacttgaaaaagttctgttatgccttttgttttctcagtttactaccagtgataatagatagtactttaggaaaatgtgtgtcgggagaaaaattgttttgagaggatttattatggaacaaagtggtatcaactattttcatagaatggaattaattgaattttgaccaaatgtgaacaaattgcattttttaacactggaaaattgttttagcagtttcatcacttttgtgggcaattttcctgaacttaacagttacagtttaacatattttaattgtaatttgttggtgcggtaattctgtctgtcctcttgtaagtggaaaatttctaggcttcttaatcctagtgtggtgctctttccatcacagcatagctatatatgtatatagctataccaggtagcttcaattattgtttatattagaggaaaatacaatttgtgcttctaaagagggtgtaatttcttagtgcagaaaacccttattcacattctacttctaataggaacatttttgcacacttaaagtatatgtgaatagttcagggtttatacatgcctacctaatattctgtctacaaaataattctattttgacattactagaaaagggtatttttaacttagcagatactatcataacaagaatgtttatttatgcttgttccagaagtctaacagtggatttgtgctttttgtttgcatgtatattatgttaaatatattgagaggaaatcagtacttttatggaagtaaaagatcaggagattttctgattttcaaagtgttgtatatgacaatggtaaaaacacttgcttgtttcagaaggtgaaggaagatgaaaagattttagatgggacctgacataggagaaaatgtcctggattcatagacagaggattgaggagtcttggcttaactgtttaattttggaaaagtctgtgaacctttctgaatcttagtatcctgtcaaattaagggatcctagtagatgaattctgtaatatcttctaattctaaaattaaattatataataccttctaattctaaaattaaattcttttagtttacacttttggtaaggtagaaattaaaataaaataagatgtcacaaactagtagttcttgaagttttacttaaatgttgaatgttgaccttgctaacctatactttccaaggtataataattgaaaaagatgagcaaatatcctgtatattttggataggactttaaaaaagtatatgggggttcatttgtaggatggtaacaaaattattacatgttcatttccttaagaatttaaacatttttattaacctctttgaaagccacttaaacttctatcaatagaaatgtttttaattgtagaataatagatttaaagtagtttttaacttttgggatgttatattactgtgttgaaaaataatggcatgtttgtaaaacatttgattttataattagatttataatatttgatttaaatgctatatatgtatcagttcagttcttaactaaggtttttttttttttttggcaaagcatttagagatttgaagcccaaatctaggtgctgttaatggtgttctgctttggtgggttaatggaaagaagcactgagtttgtagtcttatctgccaagaatcagcagaaactaataggaagtttaaaaaaatcagtcgtctgcatagaagctttaatcagaattaaacaagctacatttctatgccattttaattgcatattctacagtgcaattttcagcttttcaatgagatcactttgtgtttgactaggtaaatacaaggttttgaaaggcataagttagtgtgtgagatatttttctatacctttagtgctaagtgctttctaaatggttaggtaaatatttaaaaattccgtggccctaatgcccataaatattacttaaagttttaattttatttgaaaaaggtatacatatgtagtgtgagagcctaaaaaagagagttttttttaaagtgtggttatttactcacctaaggaatttgcaaggcataattccctgttaatttctttaagaatactgtagtatttgtgaaatttattttatggcttcagtgagtgagtgttttattccaatttcatgttactattttgtggtaaaatatcagcctacataataattttatactttattttgtaaatatagtatgtactctgccatgagtattatttttcaaaaacacagatttgatagagtcactctgttttaaaaatctcttatggcttttcattgtccacaggatactgttcatgcccttgacccttgcttgcaaagtccttcataatctgcactctgccattttttgttttatttttttaaaaagcattttattactaatgggacactccctctccacatgcattctagctatttgagggctgcttcttgttattgacattgttgtgggtttttctcttttgattttaacatctccacttgttgaaatctcctttaaggaacaaataagattaggaagactttaggcagtgcactgatactcaaatttatgtataagctgagaacaaattatagcagaatgggccatatttaaaaataaaagttgacaaaccatatgaaacagtgctgatgagtatttccattatagtgcattagatagtcacatctccataatttgtttttatacacttagtagaaggtaaccataagtaaaagcataaagtttgtttttcattgtcatcagactctgtcctcctcagtggcaggcccttctctcattctttctcttttccctttcaattaccaagtcagcttatttccctagcacactcttctaagccttctgtaccccattcaaagcaaaaatttattcttgccgaaaaagcctatttcagtataaatgttggtatagatatataaaatataggacaggttcagagtttatctaatctaattgaaatctgctcattatatattgtacaaggaaaataaattgaactccagagagataaaaatactggctgagggttattctgtgagatatttggaaaacggggactagaacctaggtctttactcctagtccacttttactttccacaaggagcatatatacttcccatcatagccttccaaggctgtacttaattttgccaggtatctccaattatgtgaaaaaaggcagtgtctctggttaaaggaggtaggcaagaagtgagagagagtcagttaagagggactcttgaaaatcctatagtttgtaatgaccttgatgacaaacttctgatacagttatttcagagtaatttgtaaggatgcagctggtcgcaaactcatgtacctacataacatttattttatatgttgaagacagaggggagggtcaaaaggagagtaggaagaatggaagtgaactgactattgcctgcttcgcttaaaggcattcagtttaaacaaaagaaactgaaaaactgttagctaaacaacattttggaagaactgggttctgtctgtgggtggttcctgacagtttataacattgacttgttgttcatcttgttatttacaagctgatctgcacttatttaggttgttgttataagcctgttcttagaacttggggcagaagagtgtatctcccacttttttttttttcttttacaaccaacaactttccttctggcattgatttacctagcagataactttacagatttctcctcctccatctgctacagcacgttctttggccacctcttccttacatttcatacaacttgcattcagcaatgttttttttttttttttttgagacagggtctcactctgttgcccaggctagggtgcagtgatgtgcaatcttgcctcactgcaaactctgccttgcaggctcaagtaatcctcccacctcagcctcctgactaggtgggactgcagtgcgtgccatcatgcccagctaatttttgtatcttttttttgtagagaaggggtttcgctgtgttgcccaggcatgtctcaaactcctgggctctagccatctgcccaccttggccaaagatgtccacatttgagaatatgttaccttatgtggcaaaatggactttggagatgggtttaaggattttgagatgaagatattatccaggattatctgagtgggtgcagtgtaatcatgagggtccttaaaaagtagaagagagaggcagaagagattagagaagatttgacagtggaagcagggttggagtaatacagtgtgatacacatccacccttgggaggctgaggccggagaatggcttgaacccgggaggcggagcttgcagtgagccgagattactcaacccatctttgctagctttggtgatgaaagaaggggaccctgagccaaggaaagcaggcagcctctaagaagatgaaaaaggtaaggaagtagattttttccctagagctcccagaaagtattgaagccccaccagcaccttggtttagcttagtgagacctatatcagacttctgacttgcagacctacgagatacatttgtgttattttatgcctttgaatttgcgataatttgttacaggagcatactagtttgctagggctgccatgacaaagtagcacaaactaggtggcttgaacagcagaaatgaattgtctcaagttctggaggccagaagtccaagatcaagttatctccagggttggttccttttgaaggctgtgagggagaatctgttccatgtctttctcctagcttctggtggtttactggcaatctttggcttgcagatgcatcacgctgatctcattcttcatcttcgcatggcattctccctgtatgttcacatagtctttccctgtacctgtctttgtttccaaattttctaatcttctaaggatccaggtcatattggattggggtccaccctgattatccccgtagagaccttatttcctaataagattacattctgaggtactgaggattaggactcaacatatttttttggggcgatacaattcagcccatgtaggtagaaacagaaaactaaagctacgtaaaattgaattgtttttcaaaatggatgctgaatataaattgatacatttatatttttgctatcagtgagtaagaatgcccctggatccacattcttatcaaccagtgcttcctatttactgacttttaagtttggctagtctagtgggtatgaaatggcatttctttgtgattgtaatctgcatttttctaatttctagatttatatgtatgttgtgatgtagagattcaatctcattttttatccaaatggatatccagtcatgccaacacactatattgaaaagtttatttattctccattcatcagtgctgcctctgtcctatatcaaatttcaatatatgtatgactgtatctgggctctattatgtttgatttgttagtttatgcatcttgtgttaataccacactatcttagttataatagctttctaataagacttaatatcctgtattgatagtgtccattgatgtgcaaaagttttcaattttgatgaagtttatctactttttcttttgttgcctatgattttggtgtcatatcaaataaatcactgcaaattcaatgtaatgaagctctcattctgtgttttctttgaggagttttataaaagttttagttctaatatttaggtctttgattcattttgagttaatttttgtatacaaaattttgtataattacagtgtaaggtaatggtccaactttattcttttgcctgtggatgttacatttttctaagaccatttgttgaaaaaaactgttaataacctttcaacaaagtgttggcttctttgttgaaaattatttgacagtacatgtgaggatttattgctaggctctctgttctatgtcataggtctatacgtctgtgtttctgtcagtaccacactgttttgattattgtatcttttagtaagttttgaaatcatgaagtttgagacctcaaactttgttctttttcaagattattttggctatttgagtgtcctttgagattccaatatgaattttaggatgaatttttctgtttctgcaaaaaatgtcattggggtttattttttattgtggtaaaaaccataaaatttactctgttctttatttttaagtgtacagttcagtggtgttaagtatattcacattgttgtgaaacagatctccctatcttttccatcttgcagaactgacactctatactcattaaataacaactacccttccgctgtcccctgataatcaccgtttgactttatgtttcaatgaatttgaggactttagatacctcatataagtggaatcatacagtatttttttgtgacttgcttatttcacttagtataatcatctttgggattttgatagagattgccttgaatctgtagattgcttttagtagcactggcatcttaacaataataggttttctaatccatgaaaatgggatatcttttgatttatttgtatattaatttatttcagcaatatttcatagttttcagtgtatgagtctttcacctccatggttaagtttattcctgagcattttattcttttcaatgctgttgcagatagaactgttttcttaatttcctttttgaattatttatagtatataactctatgcaactgatttgtatgtgttgatttttatatactgcagctttgctgaatttgtttgttctaatggttttttttggtggaatcttcagggtcttaacttagtttttgatccctaaaattagtgctgcatatgtagactcagaaacctcacgtaaaaatttaaattggcctcaggttggcaatgttccaaggcaatggttagaagcaaattcagattctccaaggcctcaaataattcctacagataaaatcccaaggaaattcagcagtgcctagtcaaaaatccacaaatcaggcaaggtaataaggcactatgaataagaacctaagaaaaagtacacaacaaaaacacatccgccctcgggaggctgaggcaggagaatggcttgaacccgggaggcaaagcttgcagtgagccgacatcatgccactacactccagcctgggcgacagagcaagactccgtctcaaaaaaaaaccaaaaaaaccaacaaaaaaaccacacccaccaaagcttcggattatataagaaatataaaaacacgtttattatgatgaaagaaataaaatagaaacctgaaaaaaatgattgggggacaggtgattaaaaaaactgtcgctggccgagtgtggtggttcatgcttgtaatctcagcactttgggaggccgaggtgggtggatggcttgaatccagaagttcgagaccagcctgggcaacatggcaaaaccctgtctctacaagatacaaaatattagctaggcatggtggcgaatgcctatagtcgcagctacctgggaggctaatgtgggagcatcacctgagctggggaggtcgaggctgcagtgagctctgattgtaccactgcactgctgcctgagtgacagagtgagactctgtctcaagaaaaatcccccaaaaccccaaaacacacacacacaaagttatataggtcagaagagttggagaataagaagtaaagtataacttggacttaattgaagttcgaaaaggggataataaaatggagaggaagaaatattagaaaaaaatgtctgtaaaatagcattttaaagaactgatgaaaaatgccaagtttttgtccagaaagctcactgaatctcaagcagaataaattaaaagaaacccatacattattgcaaaattacagaaccttaaataaaaagataactactaaaagaactcagaaaagagaaatggccttcaaaagaatgaatggcagttttactgaaaggtgacttattagtagccacagtggaatccataaagcagtggaatatcatccgacaggtgctgagagaaaataagtgtcaaactagaaatcagtgccccgcaaaactatctccctaggaaaagtgcaagctaaaacaattttagaaaaggaaaaattgagggagtttttaccactgaaagtacatactcaggcagaagaaatgaatgagatcaagaaggtatactaatgataaatataggtaaaactaaacaaacactgttattataagacattattaacaatgtcttctaagagaacagactagaactaaagtgctagaaaacaatagcatttacattggaaagaagaaattagaagagtatgttaaaaagttatatttcaaggggagggctaagagtttgactttaaatcttgtttatatatacacagcagctgtctacacacacacacacacacacacacacacacacacacacacacacagagctagtgcaactgctgaaagagtagatattgtgtgaatggcttccaaacaaatagaggtgacaaaagaattgagggaaaaaaggagaccaaataattaatatcagagaaaaaaggaggtcaaaaaaggaaacctaggcgaacaggacaaatacttaaagcatgtaaaaagatgatagaaataaatctagatactaccacgaatcacaataaatatagaagcaaaaactttgttaaaagaatataaagattgtccacttggattttctgactgtatactctttgcaaacataagaatttatcaaggttggaaataaaagaatggaaaaaggacacaagacactataataaaactggtaatattaatatcagaaaaactgggaaaacactttgctagagaaaaagatgatcattatgtaattataaaagactgaattcaccaagaagataaaatttaaaattgtagatacctaataacataaatgtctatgtctatatatatacatacacatatatacacacacatataattatttccaaattcacctacagtagaaagcattccttttgtatattttatttatacctttaattcattcctatcacattaatatactcttcttatactgtcttaattacctttcagttattagcccccttttttgagcatctcagtgtgctaggtgctgtgggggaaatataaagatcaataagatatggttctatccctaaggagtttatatctagtagactcagatgtgcagactagctcaccatgagacacaattgtgtaactgctgtgttccagtcgagcacctcattgtggaaggcaaatagtgatcagtttttcgggggagtgtattggaagtctttatagaggaggcatttgaaggacatattatataagacttgattaagtagagacaggcgttgagactggtaaaccatgtgatggtaaaattcatgacattgttgtggaaatcagaatggaaagctagtaaagtgaggagtgtagagttagtgtgggaatgttactggaaaagactggaagattggttgagagtaatgtatggaagatattgaatgccatcctaaactttttgatttattcagtggaagatgttggaagattttcagaagagaagagacattttctttatttagtttagagagattattgacaatgggaaaagtagatcagagaatgaaaatattgggagcagggagcccgttataatcatttatatgagagactgagaacagtgggagtggaaaagccctggtgattggaaaaaaggaggtatgaagatgcttaaagtcttagtgactgaaagtttactggtgtcattagctaatgtagggaacattggaagatgagctggtttgggagaaatgctaaagagcttgactattgattaatgcatgttccagttttcacatgtgaatggttgatacctcttttacatctctaaatgggatgtaaactccctgagtgtaagaactaagcatttctgttttgtatttatcatttacattttggagttcacaatggatatctgttattatatttatacttattgtcatttcttataatgtttccatgttaacctttagtgaagaaaagaactgtgggtggagatggatcccaatttcctactgtctttggtattttccttaatagacagttattgcacagtggtgaagctagactgcttgagtttaaatgtcatctctaccacttacagaatgttggacaagttgtttaacttctctgtaccccagtttctctgtgtataaattaggggtaatcacagtacctatcttattgatgtgaaatagatgtgatatgaaatgttgtgaggattaataacctgtaagttcttggaacagtgtctggcacctggcaagttttcaacagattagttgttatggctgttactattaatagttgaaattctcatccttgaattatttaatagtttatgccaagtttctctaaatcaatggtaaaacgaattgaaatttagatctatgagacaatccgtttttattgtctcgatacttctcttgggactggtattaagcaaaaaagcaaatcctttccataagggattatataggggaaattctttcaacagtggtcagtatttaggacaacaaagaaaagatacaaggagtaatttaaaaagtgattaaaaggggggtaatttggatttattttcttttaaagtttcagagttaaagattaagaacctttggtcttccagaagaaaaatgtgtcagctgctacagtcataatttactgtcccataagctttttgttccagtttgtcactttggagttgggagtacactgggaagtcaaacaaatgtctttacccataattcttccttcacagttcactgtctgttaagcatgttgataactatgcagcacctccccaggaatggtaagagggagataagagatacggaaacagaaagaagagaaactgtatgtaaaaaagtgactcttccaaccctctttttcactccagtcagtattagtcactttactttactgcttcaatgtaacactttgttccacttttcagaaaaagtctcctgaagagcttctaccagttagatagtaatcgttaaaagcagacaaaaataaatatggataggaatttttaccaatatatgggaaaatatttttctttacgggaaaatacttacatacacattactaaataccagtgtttatcattatgtaagtcattttttgtttgtttttgttgtaaaaatatgcaccatctacaaataactttaatacctgaaaactcatttcttcagcagcattactgggcattctgctaggagctataaaggctatgaaaaagaatcacataatgtcattattcttaggagtttaatgtaagataaaaagtgaagattatattttaaataataaaacaggcagtgcaattaatattgtagtgtttgagaggtctcaaaaaataacacccaaattccctgcccaaattttgagaagagagtgacagatgagatatcagaatactacctgtattcctgataaagctgttattcgaaggcatggcttgtatcagtagatagttttgctttctaataccaaaccccagagttaaacagacttccctggtcattagcagaataggaccaggaacattttccctgtttgcctggagagcctatccatggagaagcattggagaacttctgcttccatctagtgggtaggcttccaagagcaaaaaaaggggtagaattatgcttacatgattctttagtctaaacttaccagtcaggtaagtcactatcctccttctaggggataaataagtgaaagggtagagagagtccaaaaatatttagcaacagttcttcctcatagaagccataggattgagaaaaaggcattgcctctctcaacacgataatagaaaaagctatttgaaattctgacatcttttagacaacatatattttaatttttgcttgtcgcctttcttttttttttgagatggagtcctgctcttgtcgcccaggctgaagtgcaatggcactatctcggctcactgcaacctccgtctcctgggttcaaggattctcctgcctcaccctcccaagtagctgggattacaggcatgcgccaacactcccagctaatttttgtatttttagtagagacgggggttttgccatgttggccaggctggtcttgaactcttgacctcgtgatccgcccgcctcggcctcccaaagtgctgagattacaggcatgagccaccgcgccagatgtcacctttcttgtaactatagtgtctatatagttgcatggaatgtacataatttaaaaactgagcctagattctgcctttgttcatttgtttctttcttgacaaaatcaagtcacttatttctgtgcatttattgttgcacttaatattctctatcatatttgggttgataggcctttcctgtctctacattttatgtcctttaaattcagggacagtatcttatttatttatgtgaccctggtgcttggcatatatcaaatagtttattgagttggattattggattaaatactgtttttttaaatcacttcgcaggacatttttttcctagttgatacataatactcataatttcatcactgaaagtaacttgaagaacaggatgcctaaggaataagttcttgatgtcacaaaacccagcaaaaatcttcttcagcaggggaagcttacttaggtgaatgcctcagtttataggtgaagcttggaagaatgttgcaagttgggagaatggaaactaatgcaggacattgtgtgcaggagttgcctctaaaataaaggaggagcatggaatgataatttgaggtgaggtcatagtgaggcagtagggttataaacagttttgacattactttttcagatatggcttgcagagttaaaaattcctagatgtttcaatggttctcagttaacaagtgttgatagaacattttcagtgcttagactgcacttttgatttctagggagaacttcatttttaacataaatttactaattttagtagttcaccaaggaagaagatggtagtaaaatactggtcataattatttagcaaactctggaaatgtgattttttaaaaaaacttttctttaagttcaggggtacatgtgcaggtttgtaaaggtaaacttgtgtcatgggagtttgttgtacagattatttcaccacccaggtattaagcctagtacccattagttatttttcctcatcctgtccctcctcccactccggtaggccccagtgtgtgctgttcctccctacgtggtcatgtgttctcatcaagtacatttttgtcaggtaactgaagtttatctttttacaagtaatatctttttaattcaaacacatttttgctgtgactatttctattatgtttacccctatttctgcttaccctgaatagatcttgatgaaaataatatatttctctgaaaagtaaggattgtcattttaaaaattagtaaacatgtatttgacaaaattattagcaggcacagcagaagcagttcatacaatctgtttggtaaactgagtgatctcccagttctgtgttcccccaaatagttcacccacacattccataaaaggttctctttaggcagatgcaacaataccctgaaggcataattgttagctttatagtcagcattaggcaattaaaatcctccgaaattaattccagacttggctgtaaccctaagagccattctggaagacagaggatgtagagtttacgagatcttatgccctgtttataagggaggggaatatccccaaaatatttaggagagttcacacatactgaatgccactaatttcaacgacaagagcttatttctaatattccttatattattgcttctaatattctttttttttttttttgaggtggggtctcgccctgttgcccaggctggagtgcaatggcatgatctcggctcactgcaacctctgcctcccaggctcaagcgatcctcccacttcagcctctggagtagctggggctacaggcacgtgccaccattcctggctattttttttttgtattttgtagagatgaggttttgctgtgttgcccacgctggtcttgaactcctgagctctagtcatctgcccaccttggcctcccagagtgctgggattgcaggcatgagccactattcctggccccttctaatattctaatactagaatattccttatattattctttctaatatttcttatatttctaatatgccttacattagtctttagggctaataggaatagcttctgaagtgcttataatagctgcttcgggagtgtggcctttctgattaaatgctagctgatcacccttagaatataaattcttgttaaataacatatttacatttaaatagcaagaaaggagaatgtaagcatcctgaagataagaatttttgcctgttttgacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactataagtagttcaaccattgtagaagacagtgtgacgattcctcagggatctagaactagaaataccatttgacccagccatcccattactgggtatgtacccaaaggattataaatcatgctgctataaagacacatgcacacatatgtttattgtggcagtattcacaatagcaaagacttggaaccaagccaaatgtccaacaatgatagactggattaagaaaatgtggcggttaagaggaggatagtcgagatggccgaataggaacagctccggtctacagcttccagcgtgagcgacgcaaaagacggttgatttctgcatttccatctgaggtactgggttcatctcactagggagtgccagacagtgggcgtaggacagtgggtgcagcgcaccgtgcacgagccgaagcagggtgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacaagattatatcccgcacctggctcggagggtcctagcccacggagtctcactgattgctagcacagcagtctgagatcaaactgcaaggcggcagttaggctggggaaggggcgcctgccatttccgaggcttgcttaggtaaacaaagcagcaggtaagctcgaactgggtggaacccaccacggttcaaggaggcctgcctgcttctgtaggctccacctctgggggcagggcacagacaaacaaaaagacgcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcacccccaagtaggggcagactgacacttcacacggccgggtactcctctgagacaaaacttccagaggaacgatcagacagcaacattcacggttcacaaaaatccgctgttctgcagccaccgctgctgttacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccagaagtagataaaaccacaaagatggggaaaaaacagagcagaaaaactggaaactctaaaaagcagaacgcctctcctcctccaaaggaactcagctcctcactagcaatggaacaaagctggacggagaatgactttgacgagttgagagaagaaggcttcagacaatgaaactactctgagctacaggaagaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagccttaggagctgatgcgatcaactggaagaaagggtatcagtgatggaagatgaaatgaatgaactgaagcgagaagggaagtttagagaaaagagaataacaagaaacgaacaaagcctccaagaaatatgggactatgtgaaaagaccaaatctgcgtctgattggtgtacctgaaagtgacggggagaatggaaccaagttggaaaacactctgcaggatattatctaggagaacttccccaatctagcaaggtaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccatccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagcccctgcaaaatcatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacactcctcacttcaaaaaacctgtctcacgtgcagagacacacataggctcaaaataaaaggaaggaggaagatctaccaagccaatggaaaacaaaaaaaggcaggggttgcaatcctagtctctgataaaacagactttaaaccaacaaagatcaaaagagacaaagaaggccattacataagggtaaagggatcaattcaacaagaagagctaactatcctaaatatatatgcacccaatacaggagcacccagattcagaaagcaagtcctgagtaacctacaaagagacttagactcccacacaataataatgggagactttaacaccccactgtcaacattagatcaacaagacagaaagttaacaaggatacccaggaattgaactcatctctgcaccaagcggacctaatagacatctacagaactctccaccccaaatcaacagaatatacatttttttcagcaccacaccacacctattccaaaattgaccacatagttggaagtaaagctctcctcagcaaatgtaaacaagcagaaattataacaagctgtctctcagaccacagtgcaatcaaactagagctcaggattaagaatctcactcaaaaccgctcaactatatggaaactgaacaacctgctcctgaacgactactgggtaaataatgaaatgaaggcagaaataaagatgttctttgaaaccaacgagaacaaagacacaacatatcagaatctctgggacacattcaaagcagtgtgtagagggaaatttatagcagtaaatgcccacaagagaaagtaggaaagatccaaaattgacaccctaatatcacaattaaaagaactagaaaagcaagagcaaacacattcaaaagctagcagaaggcaagaaataactaaaatcagagcagaactgaaggaaatagagtcacaaaaaacacttcaaaaaatcaatgaatccaggagctggttttttgaaaggatcaagaaaattgatagaccgctaacaagactaataaagaagaaaagagagaagaatcaaatagacacaataaaaaatgataaaggggatatcaccaccaatcccacagaaatacaaactaccgtcagaggatactacaaacagctctaagcaaataaactagaaaatctagaagaaagggataaattcctcgacacatacaccctcccaagactaaaccaggaagaagttgactctctgaatagaccaataacaggctctgaaattgtggcaataatcaatagcttaccaaccaaaaagagtccaggaccagatggattcacagccgaattataccagaggtacaaggaggagctggtaccattcctcctgaaactattccaatcaatagaaaaagagggaatcctccctaactcattttatgagaccagcatcatcctgataccaaagccgggcagagacacaacaaaaaaagagaattttagaccaatatccttgatgaacattgatgcaaaaatcctcaataaaatactggcaatccgaatccagcagcacatcaaaaagcttatccaacatgatcaagtgggcttcatccctgggatgcaaggctggttcaatatccgcaaatcaataaatgtaatccagcatataaacagaaccaaagacaaaaaccacatgattatctcaatagatgcagaaaagtcctttgacaaaattcaacaacccttcatgctaaaagctctcaataaattaagtattgatgggacatatctcaaaataataagagctatctatgacagacccacagccaatatcatactgaatgggcaaaaactggaagcattccctttgaaaactggcacaagacagggatgctgtctctcaccactcctattccacatactgttggaagttctagccagggcaattaggcaggagaaggaaataaagggtattcaattaggaaaagaggaagtcaaattgtccctgtttgcagatgacatgattgtatacctagaaaaccccattgtctcagcccaaaatctccttaagctgataagcaacttcagcaaagtctcaggatacaaagtcaatgtacaaaaatcacaagcattcttatacaccaataacagacaaacagagagccaaatcatgagtgaactcccattcacaattgcttcattcacaatttgattcctggaataaaatacctaggaatccaacttacaaaggacatgaaggatctcttcaaggagaactacaaaccactgctcaatgaaataaaagaggatacaaataaatggaagaacattccatgctcatgggtaggaagaatcaatatcgtgaaaatggccatactgcccaaggtaatttatagattcaatgccatccccatcaagctaccaatgactttcttcacagaattggaaaaagctactttaaagttcatatggaatgaaaaaagagcccgcatcgccaagtcaatccaacaccaaaagaacaaagctggaggcatcacactacctgacttcaaactatactacaaggctacactaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccgttcaggacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacacacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatgacaatcattaaaaagtcaggaaaccacaggtgctggagaggatgtggagaaataggaacacttttacactgttggtgggactgtaaactagttcgaccattgtggaagacagtgtggcaattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatatggcacatatacaccatggaatactatgcagccgtaaaaaatgaggagttcatgtcctttgtagggacatggatgaaattggaaatcatcattcccagtaaactatcgcaaggacaaaaaaccaaacaccacatattctcactcataggtgggaattgaacaatgagaacacatggacacaggaaggggaacatcacactctggggactgttgtggggtggggggagtggggagggatagcattaggagatacacctaatgctaaatgacgagttaatgagtgcagcacaccagcatggcacatgtatacacatgtaactaacctgcacattgtgcacatgtaccctaaaacttaaagtataataataataataaaattaaattaaattaaaaaaaagaaaatgtggcacacatacaccatggaatactatgcagccataaaaaaggatgagttcatggccttcgtagggacatggatgaagctggaaaccatcattctcagcaaactgtcgcaaggacaaaaaaccaaacactgcatgttctcactgataggtgggaattgaacaatgagaacacatggacacaggaaggggaacatgacacaacggggactgttgtggggttgggggagggtggagggatagcattaggagatatacctaatgctaaatgacaagttaatgggtgcagcacagcaacatggcacatatatacatatgtaacaaacttgcacgttgtgcacatgtaccctaaaacttaaagtataataataataataataataataataaaagaatttttgtctgttttgttcactgccatgtccaaaataatgcctggtaagagctcaaatagctattgaatgggtaaatatcacactgactttgctgaagtatttaaataattttcagacattataaaaagaaatacattttggccaaaagcttaattaatgcaagagtaaaaaaaaaaaaggtttgaagcatacaatcctatttcagggggctcaagagtttaaaaggaagaaagggggagacatccaggtaagaggacacgtatgctgtctttccaatattggacattatctactttttctgagacagtatcgacgctttgagcatgacacatctttttgtaacagagtcctacttaagctcaatatttaattggtacttagagccaagaaatacatgtgggcctacatttttttgcatgtattttgtgttatagcctctatacaatctaaggacacttggttctttctctcaaaatcctttcctcacttttgagtaatttacttttgaatttataaatacctcaccttattattcatcatattatttgcattatgttaaaccctggtcaacccttaaaatgttaaaggaaagacattactatattttttaatgaatacactaaacttttaagtacaaatatatttgtcatcagcctctgcaaagccatcagatgtttgaaaaaaaattttaagcatgaagcaaagagtctagttttaagaacttagctgtgaatggatgatatcctacccatttaatagagttctccaaatgaacagaaagtatacaatgaaaggaaggtcccttagacatttgaagtttttctgcagcacaatcctgtctgtctgctttattcaagaatttgtagtcattttcagaattcattccagaaaccagcttattcgtttagatatcagcacactggtcttggcaaaagataacacaaaagtaaacactactatgtcaaaaaggatgaaaagccagcgatccaaccagtagaattgttttggaagctgtttgtctcggactgagatcacacattaagccttggctgttgccttccattcttgcacaagcctccctgctcctggggaccctctgtaagagtgagcgtcctaatgaaaatagatggcacactcaaatggctaaagtagggagagtttatgaaggaatgatttataaaagagtgggaagtgttaagagaacatggtatgagtatctgatgagcaacagcagatagccgttatcacctttagacatacaagggcagaatagggagctgttaagactcagagagtagctgtatagagattcatttgaaagaagccgtggctctggtagtagaggagcatcactaaccagaggtgattttacatgagagcaggggtggaggtgggtgggagagtgggggagaataactaccccaggctcacttcctgtctttctgtcttctgctcttgtattccattggttgactccaccccaaagacagagggcaaggggggctttggatataaacaagagtctcctggggcactgaacagggtggaggagaatgaagaatggatctggaggggcaaatgaaatattcgtaacactacctttttttaaattatacttttaagttctagggtacaagtgcacaacgtgcaggtttgttacatatgtatacatgtgccatgttgggtgtgctgcacgcattaactcgtcatttacattaagtattcctcatgctatccctcccccctcccctcaccccacgacaggccccattgtgtgatgttccccaccctgtgtccaagtgttctcactatccaattcccacctatgagtgagaatatgcggtgtttggttttctgtccttgcgatagcactaccatttttttaaggacacagtatctgcagtatcggaggaaggtccttttaggaagaatcatgtaaacaaagggtagaggagtattgaaataaagagtatgttgagaaaatggaaaatatttcagatagtttggagtgtgtgcttaagaagaataggcataaaaatgaaagcataggttagtatttgtagacaaatgttaatctttatattgcatatcctcttatttattactaagtcttgtattataaatgtttttataaatacctgagaatcaatagtgccttcatcattaggtgggagatagttggtcgagttttgtgccttagcatagttatctgggtgatttacacatagcggcttagtgcaaatagtacaaagatcagaagtcatttagagagtggggctttcagttaagaatataggctctggatttgcaccatctgtgtttaatttctgactccagcactttccagcttgatgaccttaggcaagttatctaataccggctcagttttctcattttcaaaataggtacagtcataatagttttattttagagtagttgtgaggattgagtaattcacatatttagcccagagcctagcagatactgttaataaatgttacctattttttgttttttagtttaggagggtattataggtatctttgaatatttgaaaggctgccccatgaaatagggattaaacttgtcttcatgagaacctccagtatcagaatcaggagtaatgtgtataagtaacaggcaaacagatttgggattaatacgagaaaatcttttaatagttatagagttgcttgaattagaataggttagctcatgagataatgatttacataccaagggaagttttcaggaaaacatcaaggggatgttttaaagtattaatgtctcaaaatgagaaaattagataaaagctttaggatatcttccaaccataatagtctattactttatcctaaaaaatttgtgaaaatcaaattttacgtaagaggaaatgtgtttgatttccttttccacatctctgtctgttcctgttgacaatttctgttcctaactaccttccaacaatccagcttacatgtcatctatctttgtttaatgatacgtataatttttttttttttcaagagacagagtctcaccatgttccccagactgggcgcaaactcctgggtaggtaatactcttgcatcagtctcctgagcagttggtactacaagtgcacaccaccatgcccagcatatttaacaatatttattgagcacatacaaatgtgccaggtattgcgctggatactgtgattagtacagtgaacaagacacatcagtctcctgccctaatggagctttaagaaattttagcagagggaaatagaaagtaaaaacacagtgaaataaatttcaggtagttttaagtactgtgatgcatgaagaaaataaaacagaataatagtataaagggatactagggctttggatggtggaggtgaagatggtgctttaggtatggtaggaagggaaagcctctctgaagaggtgacattttaaccagcatataaatgttgagaaggagctggttgtgctgagggaagcacactctaggcagaagaaccagcaaaggccctgtggtgggaaagatcttgacatgcttgttagaaagcaaactgggtggctagagagtggtgggagtggtaagaacagtgtggatcacataaggccttatacaccttgttaacatttacatttcactccaattgcattctaatggcaagtcatgagacaattttatggtataatttatgtttaaaaaagattattcttgcttgtttatgggctattgacggaatagctagagtggaagcaggaagataggaggctgttggagttatccaagtgagacataatagtgacttggactatctcagatgactttctcccccatttatccctggatagaatgtcctttaaaaaatattttataggccaggcatggtggctcatccctgtaatcctagctctttgggaggccgagatgggaggattgcatgaggccaggagtttgagaccagtttgggcaacatagcaagactctgtttttacaaataattaaaaaattagccaggcatggtagtgtgtgcctgtgttcctagctacttagggggctgaggtgggaggctaggaatttgaggctgcagtgagctgtgattgtggtactgtactccagcctgggtgacagagtgagaccttgtcttgaaaaaaaaaaaatatatatatatatatacatatatatatgtatatatatattttatagtgtttaccagatactagtgttaaagtatctttatattatattttaattaggtatacaattggctttctcattagattctgagtttcttaagcacaaggacaatgtcttatcccttttcttattattttaggtagcattatagcactgttattaattttgcacttaatgcattgctattaagtgaattcatgaaacttctatctgaacacagggctttttatagctattacaaatggcacagttaaatacgtaagtgcaataaggtaagctagatttgagatggaattaaaaaaatactttcccatactttacacacagaatgtagtttgtatacagtttaggaaaacctactaagaagggaaaatcacaatgttttattaggggtgaaacacaaatcagaaaggcttagggaaataaaaccaagaactagttttgttggtctatttgttatgataaaggctaaactaatgttaacaagagacaaatatagtggctcaagtaagaaagaagtttatttatcatataacaacaggtcacacattcaggctgctgggtctttcacgggctccttcctttatgttgctctgccacctcttagggtcttgtcttaatctgcacggtcaagctaggacattgtcacacttatcttccagtcagtggggaaggggaaagagagagtccacagagtccagataaataattttattttaaacaagtgaggtgaaagttgcatgtatcatcttgctcatattccactggtacttagtcatatggtcttactcagctactagagagatggagaaatgtagtttttagctggggagtcatagcaaaaactttactttttttttttttttgaaatttaaagaaaaaatctattgaagatctgaaaaacaattcctaaaagatagacttttccagaaaacactagctacacaatgtattgtgtctatcatgttaaaacatgcattagacacaaatacaaaaaccatgaaacaagccaccattcttcaacaatttgagcaaagataaaatgcctaagtaacaacatggatgacttgcaaaggatgggctctttactttaagcaccataaaaaaaaaaagcacaaatggatgagtgtgttcagttatatacactgaattgaacctttggcactaggaatcagagtattttgtcatatagcattaacatgtattataaaagtgcgtagtgtcaaaggaatagaaccaccaacattcaaaagcagctttgtcaactaggcagtaaaacactctacagcatatcctctgttgtccatcattgaatacactggtagtgactttgaaattaaaaaaaaaaagaaaaaggatctattaccccttttattttctttgtttaaaacaaaacagaaaaaaacatcagttgttacacactaacatcttcaaagcacatcgtttgtacaagagatagactaagaacaaaaatgtgtttacagagatccaaacataagtgagtgagagcgcctctcacatggctctcaggacggttctcaggaggagccacttcataatctctggcactaaacaaagttgtagaattctttgccaggtacttcaggaaatcatgaagataattcagtaattaagcaaggctcttctcatccagaggtgtataggccaacattgctccaattcgtacaagtaatctcaggagatgtggcactccatacacctgggacatgggtgccttggggtgatctgcaagaatttcggcatactgtggtctctcaaatttgtagagtagttgggtgcccaacattacgttgaagtattcttttatccctgccacaacttcattaaccgcatactccttattatctgtgtttccaccagatttcttgtaatttgcgtaatcctcaagaatggaatccacatttcttcttggcaggaagttaaaagagctgttttcgtctggtaattaagtcccagtcatcaacaagccacagttttagctcttcaggaagctttactttaacttcaactctgttcatgaatgtttcctcattttcaacagtaggatctacccgggtccttttcttccgaggaggccaaggagtctcactggtactgccaccatctccatttccaggggttttctgtttgttcttttttgttttcacttcaacatttttctgttggagaccagatgtcttctttcctggggcagcccctatcgtcttcccctctgcatactgctcctgattggctttttgaagttcttattctttctgcaaattagtgtccttgtatttgagtactctgctctctggaacccactcatcccaatttttattccaaccactgtaatgtataaagtatttcacttgtttgtccttaatggcaacctttacacactttgtttcatgaagaagaggcccatgaaagcacagcactcactcaacctcctggaatttaggctttgggtcctgttttgaagccatttataagtgatttgctgtctcctccttctcctaccacccccaactaaaactttactaactttgattttcagctaacaatcttctaaagttgctgttatttgaactacttaaagtgaatatgagggtaacaactaattaatttctgcttcttaccctcataggaaaaatattgaacttctatgtagcacttacacttagggagagacatcttgatcctgattgcaactgggatggaaaactgattttattactattctaagaaaagtttttatttgtatttttattaaaaatgaagttatgttcaaatgaaagagagtatgtatgagtcttgaaaattgttactttaggtaaggcaggactactaatttttttattatttttataaagaaacaactcttgctcaccaaagggcttgtagaaatggtgggctggttgccctcatggcaggtataaaggatacggatgtataatatttctattaaggcagtttgggataagggattacttattgcttttaatgtatatcttccttgttatcacatattaggttgatataattcttcatcaggtagaactgaagttctcagagttggagttgaggatgaaaagctgctttagaaccttttaggccttaagtcagtgtttctgttttcaggactgtctcctaaagagaggtaacttttttttctgttggatggtaaattatcacctatttctctatttcttaagagcagacataatctttggggtcgttcctttataatcttgattcagtattttttctttcttatcaatattgttattcattttattttttgcttatttaaaaaaaattcagataatttacatataataaaatgcatgggcctaaatgttgagttgaagttttgatggttatatacacttatgtaatcatgaaccaaaacaagatacagaatctttccttgaacttctttccggtctgttccatccagctcctcagagacagccacttactgatttctattgccatgtatttgttttaactgttttttaacctctttaaataaaattatacagtatgcattcttttgtgttgagcatctttcacttcatatactgtcctgtaatgcattcatattgttttgtatatcagtcgtgaatatattcaatgaatatgttccctgaatgaatatattttatgaatacatcacaatttatttattattctgtcacaatttgtttatacattcttatgttgatgaatatttaggtttccagtttttgccttatgaattaggctgctctgagcattcttgtgcaagtcttttttgtggagacatgtattcatttctgttgggtaaatacctaagagtgaaattaagtcagagtagatgtgtatttaacattaaaagaaactgacatacactttttcaaagtggttgtaccatttacactcctaccagcaatatatgagagttccagttgccctacatcctcactaacatttgatgttgccattcttttattttagccatatagtacctgtgatgttgaatgcctttttatgttcttattgaccatttatgtatcttcttttgtgaaatgttcaagtcttttgctaattttaaaattggattgttcattttcaaaaaattactggtttgtagttgttttagacagtcatgcgttgcttaacagtgaggatatgttctgagaaatgtgttaggtgatttcgtcattgtgcaaacatcacagagtacttacacaaacctagatgttacagcctactccacacctaggctatatgttatagcctattgcttctaagatacaaacctgtacagcatgttactgtactgaatgctgtaggcagttgtaacacaatgctaagtatttgtatatctaagcatatttaaacatagaaaaagtacggtaaaaatatgtacacctgtatagggcacttaccatgaatggagcttgcaggactggaaattgcatttggtaagtcagtgagtgagaggtgagtgaatggaaggtctaggacattactgtacactattatggactttataaacactgaacacttaggctttttagttttccaattactttataaaaaagtaaccgcgtcacaatgtcatgacagctgcaactgaaagttcattatgtggcatgtcactatattatggatgtgagtcctttgccatatgtatgtgttatgaatattttctctcaatctgttgcttacctcttcattttccaaatgtctttggataagcagacattttaattttgtttaagtctaatgcactaatttttttcctttacatttagtgctttttttataccttaagaaatttttgcttaagcatctctaaggtactctgttttcttctagaagttttatggtgtatgatctaacttgaagtaattttttgggtatgaggtaaggtagggggtcaaagtttgctttttccatgtagataaccagttgttccagcactgttttgttgaaaagacttgacacccttgtctaaaataaattggtagtatatttgttggcttacatataggaagctagccttagtttttaattttttttctgatttaaattctaaaaaaaatgaaaaccagggatagaacctataatgggtaagatggcacttatcttgttgtattttagagttttctggtggtgtcattttcagaatacattttgtgttcctcagaataaaggaaatgaagcttatttcttttattctcaagccaaatcactctctgaggattgaggaagtaatccagggtttgatatggggctcatggcataaggttaggtagcctgttatctttaactttctagattacttcataaaaataacttgcgtatatgtaatgatatctttctatgttttagatgttgttcaaagcactgaattgtaaacatattctcaatatttccctcgaatcttaagtatttaccttttattttttttaatttaaaataaaaaattaacagagtaaaatagatgttttttggtgtatggttctatgaattttaccatgagtatagattttgtatatccactacaacattcaggacatagagttgtcccattacttccagaagttcccttgtgctttctatccctttgtagttatatcttccttctatccctaatccctggtaactactagtctcttttccttcactgtagttttatcttcttgatgtcataagtgaaatcacacagcatgtaaccttttgagactggctacttttatttagcataatgcctttgagattcatccgagttgttgcatgaaccagtttatattttattgttaagtagtagtccattgattggatgtacctgtttatccattcattcatcctttttatttggggggacagagttttggtctgttgcccaggcttgagtgagtgcggtgacacgatctcggctcactgcaacctccgcctcccaggttcaagtgattctcatgccacagcctccggagtagctgggattacaggcatgcaccaccacgcctggctgatttttgtatttttagtagagatggggctttgccatgttggctaggctggttttgaactggcctcaagttattcacttgtcttagcctcccggactgctgggattataggcatgagccactgcacctggcctatccattcattctttgaagaatatttaggttttttttttctagttgtgttgattaggaatagaactgctgtaaacattcacgtacaagtttttgtgtgaacattagtttttattcctctagtgtaatacctgagagtgggattgctgggtcatttgttaagtgtatgtttaactttataagaaattgccactgttttccagagtgtttatgccattttgcagttttactggcagtgtatgaaaattctagtagttccacatcctgaccagcacttggtattgttagtatttttaatttttgtcattctaggtgtgtagtggtattgcatcatgatttaaatttgcatttcgttaatgggtaatgattttgagcatctgttttttatgggtttatttacattatatatcatctttggttaagtggatataagtcttttgttggatttgtgatttgcaaatattttcttccagtttgtagcttgtttcttcattctatgaacaatgtctttcagagaaccgaagattttaattgtaatgaagttcagtttttcaattttttgttttataagttcttttgatgtaatatttaagaactttttaaccacaggacatgtatattttttcttatgttttcttataaatcttataaaaatttagtagctttatgttttaccttaagacctgtgatgcattttgagttgatttttgtataaagtgttaagtttaggtttattttctcctacatacagaatttccaattctaacatcatttgttgtgtactctcctttgtttatcgaatggctttggcacctttgtcaagaattaatttgctatatttatgcagatttatttccgggttattgattctgtcacattgatcaatgtgtcattccctctgccaataccacactgtcttgattactagaaaattgtgtagtgtgaatcttcttatcttttttttttcaatattgtttgacctttgcagaaacattttagaatcagcttgtttatatctatgaaaaatttggctgggatttccattataatcacattaaattagtagaatcaatttgggtagaattgacattttttaggctcttgagcccctatgtgtgggcccactcccactctgtggagtgtactttcattttcaataaatctccacctttgttgcttcattcttttcttgctttgtttgtgcattttgtccaattctttgttcaagacaccaagaacctagacgccctccaccggtaacatattttggcaagccagccaggatgtaaaataagtttgggatttatttttttccttttcctttctgctccacgcagtggaatctcttcttcactcgggacccttggtgggcagcgcctaaacacagaggcaactgcagatttctggctgggatcactctgaaggactctcttctgtcttttctgcttgtggttcctgatccctacatgtggagcagctcagggcgaactcacatgtgtttcaggcaacttaaatcttcttttcttacactaaatttttcccttactctactcgactggctaaggacaaaagaaacccacctagcctccagttcctatcactacagttcacggaatggagcaaagtccactttgctccatcactctagtggaacaggaagcatgctgttccactagagtgggaccaaatgctcctcctttgctccatcactgtagtggaccaggaagcatgggaaaagatggccttatcaaattttaaggattctgaaagtcagggattatacctaggaaccaaagggaagctcatagtagtaggccattgcctctggagggaaaacatgcaaagcggcactggtgcccacgtaacgtcagagacgtctgatactcttaagactggaccccaaagagggatgccccaggggatcctttggacctcaacctctctgaagggaacacccttggcagaggtcctaaggcctagtactaagccctccttagaattttatctcacagttgcaatactgtttggccccagtattgtttggaatcaagtgtgttgttgaatgggaaagtgagatggagttgcatgtatccaggctttgatgctgctgttccaagcagggtcaggcctggttatatgtgatgttctcctttggtgctgtttggccccagtgttctttggagtctggggaggtttgacctttacaaattaaactgccatggaaactgctttacctgaaattttggttcactgccttcattggattaactactggggcaaacaaaagtagaaccggcaagtttgtattgctgtctcatggctagagttccaaggtaaaagctattgaatcttcatttgtatgtgtatatacatgtctagatgtgtttatttgtatgtacacttattgttatacattctgtctacaaaactgacatacacgtaaaagagtactcataaataagtctaagtacttttcaagttcatgtgacttaagtataactttactaaacaagctggttttaaaatgattggtaaaataaaaatagaaatgacttcaaaaaaaaaaaaggaatggacattttttactgttgagtcttccaatccatggacatgatatatctctttatttacttaggtcttctttgattttattcatcagtgtttcgtaatttttagcatataaaccctgttgactttttgtttgatttacatgtaagtacagatcctcctcaacttatgatgatggggttatgtatccagataaacccatcgtaagttgaaaatattgtaagccaaaaacatatttttggcttacagtattctcaccagtcaaaaccagactttcaatttatggtattttcaccagtgaaaagcacacttttgacttaatattttcaaaccagtgaaaagcacatttttgacttaatatttttatcagttgaaagcacactttcaaattgtgatattttcaacttatagtgcatttatctagacataacctcattgtaagtcgaggagcatactgaatgtatattgcttttgtaccactgtgatacggtttggctgtgttcccacccaaatctcatcttgaatggtggctcccacaattcccatgtgtcattacttccagtgggaagtaattgaattgtgggggagggtctttcctgtgctgttctcgtgatagtgaataagtctcatgagatctgatggttttgtaagggagagtttccctgtacaaattctctcttgccatgagtgtgaggacttccctgccatgtggaactgtgagtcaattaaacctctttcctttataaattacccagtctcaggtatgtctttattagcagcgtgagaacagactaatatacattgtaaagctgaaaaattgtaagttgtaccatcataggttgaggactgtctgtatttatttcttagagctgttgtaaatggtatttaacaagaattggtttccagttgctctttgctagtatatagaaatacaattgagttttgtgtgttggctttgtattctgtgatgttgctgaattcacttattagttctagaagcatttttcatagagttcttgagatttttctatgtacagttgacccttgaataatgcagcaaggtggaagttaggggtgctgacccctgaagcagttgaaaatctacaaataacttttgactcccccaaacctaactactgatagcctgctgttgactggaagccttaccatcaacataaacagtcaattagcacatatttttatgttatatatgttatatactatattcttacaataaagtaagctagagaaaagaaaatgttattaagagaatcacaaggaagagaaaatatgtttactgtttaattcatggaagtggattatcataaaggtcttcatcctcactgtcttcacattgagtaggttggggaggcggaggaagaggaacagttagtctgtctcaggggtggcagaggcagaggaaaatccacatataagtggacctgtgcagttcaaacctgtgttcaagggtcgactgtaaatgataacgttgtctgtcaataggacagtttgatttctttctttctaatctgtatactttttatttgttattttcctgctttattgtactggctaggacttccagtaccatgatgaataagagagatgtgatattatattttttccttggttccaatctaggaaaccattaaatatgatgttggctgtagttttgtttaaatgccctttattatgttggggaggttcctttcagttcttagtttgctgagagtttttatcatgaatgaatgttgaatgctgtcaaatgcctttttttgcatcaatatgatcatgtgggtttgtttttaaactgttaatatgatggattatattggtcaatttaaaaaatattgaacagctttgcattcctagtataaatcccacttgattgtgatatattcttatacattgctggatttgatttgttgatattttattaaggatttttgttgttgctatgttcatgagggacataggcctgtagttttttgttgttttttttttaataccttttttggtattggggtaatggtgactctcaaaacgaattgggaagttttccctcctctattttcagaaatgagtgtatagacctggttttatttcttcttttttaaatatttttcttttattgatacatagtattgattttttttttttttgagacggagtttggctcttgttgtccaggctggagtgcaatggcatgatctcagctcaccacaacctccgcctcccaggttcaagtgattctcctgcctcagcctcccaagtagctgggattacaggcatgcgccacaacgcctggctaatttttttctgtttttagtagagacagggtttctccatgttgatcaggctggtcttgaactcctgacctcaggtgatccgcctgccttggcctcccagagtgctgggattacaggcgtgagccaccgtgcctggcctgatttttttcttttaatgttgggttgaatttgctagtgaaaccatctgggtctcaattttttttttctttttgtttttttggaaagctttaaactatgtgttgaacttatttaatagttatagaattactcagaatatctatctcatcattggtgagctttggtagtttgaatttttcaagtaatcgattcatttcatctaagttactgaatttatgtgtaaagtgttatttgtagtgttattttattatccttttaatatctatggagtctataatgatattcctcttttattcttgttattggtaatttatgtctatctttttttctttatcagttttgtttgaggtttataaatttttaaatcttttcaaagaacaagatttggtttcattaattttctctattatttttctgttatcactcttattgatggggagctgatcattatttcttttttttctgcttgctttaggtttattttgttcttcttttcctaatttgttaagataaaagcttagatgattgattttagagttttattcttttctaatataagcattagcttctttgagtttccctctaagcactatgctagctgtgtgccataaattttgatacattgcattttagtttttatttggttcagactatcttctaatttctcattaaacttcctctttgaatgctggcttatttagaagttatttaatttctagtgtttggagtatttctgccatctttttgttacctatttctggttcaatttcattatgatcagagaacatactttgtatgatttcaattctctgcatatatttgatgtctagatatgagattttatctgtggtacttatcctggatagatttactaggttgtagattatgtcagtcttcagttttgctagaaaatgccaaattgtttttcaaagtttgaaagtatcaggggaacccaccccccgtatttcaacgtaggttctttatattttctgtaagtgtcggccagttgagaaataaagagaaagtacaaagagaggaattttacagctgggcctctggggatgacatcacgtatcggtaggaccatgatgcctacctgagccttaaagccagcaggttgtattaagatttcaaaaggagagggggtacaagaacagggagtaggtcacaagatcacatgcttcaaagggcaaaaaggagaacaaagatcacatgcttctgaggaaacagtacaagggcaaattcagaactactgattagggtctttgttcagctgtgcacgtattatcttgataaacatcttaaacaacagaaaacagggttgaagagcagagaactggtctgacctcaaattcaccagggtggggtttttccccaccctagtaagcctgagggtactgtagggaaccagggcatatttcagtccttatctcaaccgcataagacacttgcagagcagcgtttatagacctccccccagggatgcattcctttcccagagtcttcattattaatattccttgctaggaaaataatttagtgatatcttccctacttgcacatctgtttataggctctctgcaggaagaaaaatatggctctattctgcctgaacttgcaggcagtcagaccttatggttgtcttcccatgttccctaaaattgctgttactctgtttttttttcaaggtgcactgatttcatactgttcaaacacacatgttttataatcaatttgtacagttaacacaatagtggtcctgaggtgacgtacatcctcagcttacgaagatgacaggattaagagattaaagtaagacaggcataagaaattataaaagtattaattttgggaactgataaatgtccatattaaaatgaaatcttcacaatttatgttcagagattgcagtaaagacaggcgtaagaaattataaaagtattaattttgggaactgatatatgtccatattaaaatgaaatcttcacaatttatgttcctctgccgcagctccagccggtccctccgttcagtgtccctgacttcccgcaacatgaaagtagttgtacgaatctattgcaccactccccctgccccagaatgggatatgaatgttctatatcctccctaaacctactatgtatttgatttattcattattctagtcttggaagacaattaatcactaagggaacatttttctcatctttttttttttttttttttttttttttaagacagagtcttgctctgttacctgggctggagtgcagtggcacaatctcggctccctgaaacctccatctcctgggttcaagtgctttttctccctcagcttcccaagtagctgggattacagacgtgcaccaccatgcctggctaatttttgtatttttagtagagacagggtttcaccatgttggctaggctggtcttgaactcctgacctcaggtgatccacgcgccttgacctcccaaagtgctaggattacaggcatgagccactgcacctggcctcatctttcgtgagttaagttttatatcatccttgataatttagggtatcacagtaagcatactgaagttgaaaactcaagtaggttttggttatcattccaaacgacttgaagtttctcattggtcatggagttttggctgtgaaacaggacctggggctgcctctagccagagtgattctacctatgccacaggtggacaggtaagcccttttatggttgctgaaataagtccatatcctagagatgagattagattttcaccaatatctacttccagtcttcatgctttaaatgttgaagttcttcagttttgtacaggtaaaagaaattcttcacctaattctaagtttttacctaacttcttcaaccagtcttttcattgcctgatggaattctgcctgggttttaaattcttttaaatttaaaaatttttttacgttcttcctatctgacaaagacacaagtcttccattcgaattctacaaatctcttatacctttatctgagtctatattttcaacccttatgtgctaatgacaaatatttaattccatccttaaaggatagttgattgtgggcatctactgtatttcataacctttgtaatacaagttatataatttttagtgcttaaactatactttaaagaaaataataacagtgattagtagaacttagccttgaattaatttgagactgttgaaatagtggtgaacttttaagacgcagaggaaagtttttcctttggggataagttattttaacctgagacattttaaatgacaggaaaacatctagctttctttttttatgagtgattaaaatttaaagaggaaagtaaagactgaattggctttatacttactttaaattttaaattaccttaccatctatttaacttaaaaataagccacttttattattcagttaacaaactgaatatcattctttgtttttatttttattttttttaaagacagagtctcgctgtgtcgcccaagctggagtgcagtggcatgatcttagctcactgcaagctctgcctcctgggttcatgccattctcctgtctcagcatccctagtagctgggactacaggcgcccgccaccatggctggctaattttttgtatttttattagagacggtgtttcaccgtgttagccaggatggtctggatctcctgaccttgtgatccacctgcctcggccttccaaagtgctgggattacaggcgtgagccaccacgcctggccattcttttattaaaatattttttatagtaaaaatgcaggtgtattatgttatatttattcgttttggtaatatggttttattaaacttgacgaaaatgccttccaactatccatgtgttactcagaggtatgagaatgaattagccgaacaatttgaacaaaagttaagataatagacatttagaatgcttcttgctagaatgaagttctgatttgtgaagaatattactttatcaggtagggaagatatataaaggcagaaaaattattaaattgtgacttcctaaatgtctacttaaaaacatttatggtaaatttataatgttatattgaattgatttgaattatttgaatcttaaaatatagtgtgggagcttttttctaaagtatatattattaaaagctgagaaatatttaagtggttgaaagccagtgggaaatatgaagcaaactgctaatgcaactggggagacaatagaactatgtttatttaatattaagcattaaacttatgaagattttactggaaatttgattggtttttctgtcacccaagggtattttaagcctgttttatgcattatacctgggctgtaccaagagcagatggcaagttcccaggggaactttccaactgacccataatttgagataagatgatagtttacagagctacaaaaatagtcttggggtttgccactgtttttgttttagttgcctatcagatcttttgtcaccttttctctcacagatcatatggatgacatacagttctgtttatttgtcaatatctaattgattagcataaagttataagattataattcaagaggtgaaatggatgctaattggaactcctattaggaatttgctcatcaacatacaatttctttttttgaataatcaaaatatatacttttcattatatagattcagaaaggttctgaaaacataggagatattttcttttaaagctgcactcagaattttatttctgtgatactcaggtgaaagtatgtagtttcccttttcatttaattttattaaaattgaattaaaattttctttctttttctttctttctttctctctctctctctttctctctctctctctctctctctctctctccctccctccctccatccctctctctctctctccctctccccctctccctcttctctctctcggagagaacatgagtattttcaggaaattagagatttgaatttgaaatattttttgtatatcaagaaatccatcaatctttgtttaactatggaatcttcagaacatcagagttgcatgtttttaagcttagagaaaaatggacacactgaatcttagcaactgaaagcaaatagacatacgtcagtatctgtgtatagtgctgacacttatgtcagcactttatcctatttgcttgggaactcttgtttagtagtgtgtttacaatgaggcctttcagtggagagggctacatgactgaatgtgtgtgtactctgtattgtctgagtacattctatgtgtaaactttaagatatgtttatagacatatttgttattgacatttagtcttgtatttattttatttctcagaagtattttatttgttcatttttgataactagcactcagccattcactttttatttctaattttggtgtctttgtgtaggtcactgagtgtgattccagataagttattacagctagatctatgtggctcatcagccacatatttggtttttttgttgttgttgttgtttgtttgttttgagacagtcttctctgtcacctaggctgcagtgcagtggcatgatcttggctcactgcaacctctgcctcctgggttcacgcgattcttctgccttagcctccccagtagctgagattataggtgcccaccaccatgcctggctaatttttgtatttttagtagaggtgaagtttcgccatgctggccaggctggtctcgaactcctgacctcaggtgatccaccatcctcggcctcccaaagtgctgggattacaggcctgagccactgtatgcgtcccacatatttgttttagagagggaagttcgtgcaattaaaggtggaataatctggatttgtcataagtcctatgatttcattgtgctttagttttctgaacagatacgatgaaaattatctactaagagtttaaaatatatcgctgagggttaaaataaagttcaaagtactcccaagtattatgggaatttgtctgtttcttgggaagcagggtagacgttatctaggtggaaaagacgagtgggcaatttgaaatgttagactaggagcttggaaagagagaataaggctagagttatactctagaagttactcagtatattttattgaaggcctaatatatgtcctttaagattgaagccctggaattcatgcagaccacaagactagcatctcctttgcttgtggaattgatagtctagttactagattctagagggaggattatttgctttgaaggtcataggtgaagcttgggaatggatgagactgaaaaaaaagagtgtagatatgattaaaacaattaaggacacagtgactttgggaaatacattatgtaggtttttaggagaaagacaaggactgtgggggaagtacctatgtttggtgattggcatgatgaagagtcagtgaagaaaagaggttcagagtgtcagggatttgggggatttatcattaagctaattaaatttaagctccaggtttgtcacttacataaaatcctttcaagtctgtaggaggaaggttttcacatgggcatatgtttctgtaggatttccaaaagtaaggcatttcaatattgccatttctttcattctgacttaccctcatgtcatatggcattagagtggctgcaggcatttttgggatccagctaaggggaagttgaataggatttacatttagtttgggaggcatgtatttatgtggtcatgtcacttctgaatatagactagctgttctggtataggaaggatatcaaggaatactggtgttactcactgtgttaacacttagtgttatgacacaaagatggaaggctagagatcacctggtgatatggacgtgtcctataatgcatcacattagaagtacgtggtaggataagagaaacaaaatttgaaatacacggggccagaagctagtctgggaaaaattcttccaaatcgaatggtttataaatgaaagaaaatatatgagtttctctaaatttgacaatactaaaagtttatgacattaccagtagtagtttgtgaacagtttgtgaagactattttgtaaaatataaataacaatttagtcttttgaaaattaaaaagatatttatagaaaaccttacatataattgccatatgaagaggtgataacaaaagttatgcaaaaaatatgtagaagtatactagaagtgtgtcagggagtttattgataacattattgttattttttctggattcttgtgatgtttatgatgctgtgacttttttttctcattctcagtaagtattcacctttgtatctaattttgtatttgtaattttgcttccttttttttttttttttaaagaaggccccctaaattctagaaggttcaggcccaacaatacctgggaggcacagaatcatggaagttaagaggagacaaatcacggatggagaatatgtactcttttaaatgatgcattggggtagctaaggaaggcagttgcatttggcaattcagggattattgataatcttcactaatgagtatgaatttgggagtgggaagtggaggttgtgtactttttaaagaaagtggcagtagagtccaagaacagtagcttttgaggaaagcaaggtccagggaagtttttttgtatgtgtgcatgcttcaaaggtaggtggacatctaaatacgttaaaggaagggaaaacatgcaaatagcacagaaggaaaaattaaaggcaatagcaagagaggttaaagcagtgtagaaatagtgacgagagcagggaggaaaaaggaaatgaggtcaagacataggagtgttctaaatagtagaattcagtaaaggtgatttaattgttactgtattagcactgtgctagtgctgagtgcaataattgattttcataatgctgtaatttttctgcaaatcaacattttatgcttagttcattaagatttattatacaatttataaagacttacaatcacataatttataaagattttcatttggatgtttaaaatgaaatgtttcatgacatagttggaagataattatcttaattatctaattagttgaatatgttaaaattaatcttccagaattttttgacttattaagtgattgccccaaatcagcttagagatattatcaagtattttgctagtaagttatgtaaactaattaatagaaaatacatgaaataatcttattttctcttagttttatagatggtatggaaaaaggtacagaattgtcaggtaggatatttattattattttttccatttaactcatcaaaatgtattgaatgtttattatatgccaggagcaggtctaggtgctggagatagagcagtgaacaacacaaaatttctgccttcatggaatttacattttagtggaagagacagaatataagcaaataagcatgtacgtatatattgtcagatagtaatgtgtgttacaaagaaaaataagggagagtaaggcgacagagagttgtataggatgatatttcagatagtgtggtaaggaaagccaggtaggacacttatatgttgctttttgtcagtgtatttagaaaactattttatgcaagtcaaattgtgtttactaagatcaaatcatttacaatttaataggagcaacatctgcttacctgagttttcccttctgaaattattgatttataatagtaccaggctaggtgtggtggctcatgcctgtaatcccagtactttgggaggctgaggtgggagaattgcttgggtgcaggagtttgagaccagcctgggcaagatgctgagacccccatctctacaaaaataaataattaaaaatcagccaggcatggtggcatgtatctgtagtcccaactacttgagaggctgaggcaggaggatcctttgagcccaggaatttgaggctgcagtaagctatgaccatgccattgcactccagcctgggtgacaaagcaagaccctatctctaaaaatgatatatataataataatagtatctacaccataggtttgttgcatggtttaaataagattttgtatgactgttttggtgcagtgctcttactcttcactttatatgaagtatgcctgtaaaagggaataaaacttagtatgtttcgcagatactgtgtttttcacaaattggaggtttgtggcagcgctgtgttgagcaagtctgttggcaccatttttcttacagcatatgctcactttgtatcttcgtatcacattttggtaattcttgcgaaaaatttttaattttttattagtatatctattatgactatttgtgatcagcgatctttgatgttactactgtaattgttttggggcaacacgaatcactgcacccagagaagagagctaacttaattgataaatgtgtgggttctgactgctctaccagctggctcttcccctatctttctcccctgtccttggacctccctattccctgagacactgcaataatgaaaatgggccgattaataatcctacagtggcctctcagtgctcaagagaaagcaatagttgcacatttcttaccttaaatagaaagccagaatgattggaccttagtgaggaaggcatgtggaaagctgacatacaccaaaatgctaggcttcttgagccaaacagttagtcaagctgtgaatgcaaaggaaaagttcttgaaggaaattaaaagcgcttctccagtgaacacaaaaatggaagtgaccagctttactgctgatacggagaagttcgagtggtctggatagaaaatcaaaccagtcagaacatttccttaaaccaaagcctatcccagatccaggccctaactctcttcaattctgtgaaggctgagagaagtaaggaagctgcaggagaaaagtttgaagctagcggaggttagttcatgaggttttagcaactatctccataacataaaagtgcaaggtgaagcagcaagtgctgatggagaagctgcagcaagttatctagaacatctagctaaggtaagtggaaggtggctgcactaaacaacagattttcaacgtaggtaaatcagccttctattggaagaagatgctaggactttctagctagagagaagaggtcaatgcctggtttcaaagctttgaagcctaggctgactgtcttgttagagactaatgcagctgataactttaagttgatgccagtgctcatttcccattctgaaaatcctagggcccttaagaattatggtaaatctactctacttgagccctgtaagcagaacaacaaagcctagatgacagcacatctgttggtagcatagtttactgaatattttaagtccactgttgagatctactgctcaaaaaaatatattcctttcaaaatattactgctcattgacagtgcagctagtcgtcgtccaagagctctgatggagatgtacaaggagataaatgttgttttcatgcctgcaaacataacatccattctgcagcccatggatcaaggagtaattttgactttcaaatcttattatttcagaattacatcttataaggctatagctgccatagattgatggatgtgtgcaaagtaattgaaaaacctggaaaggattgaccattctagatgcccttaagaacatttgtgattcatgggaggagatcagaatattgacattaacaggaatttggaagaagttgattccagccctcatgagtgactttgaggggttcaagatgttagtggaggaagtaactgcagatgtgatggaaatagcaagggaataaatagagcctgaagatgtgactgaattacttcagtgtcatgaaaaaacttgaacatatgagtagttactttttatggatgagcaaagaaagtggattcttgagatggaatctacttctgataaagatgctgtgaacattgttgaaatgacaacaatgggtttacataaacttagtggataaagcagtggcagcatttgagaaaattgactccaattttaaaagaagttctagtatggataaaatgaagcattggatgctccagagaagttcttcccgaaaggaagagtcaattgatgtggcacacttcactgttgtcttgttttaagaaattgccacaggccaccctgccttcagcaaccaccaccctgataagtcagcagccatcagtattgaggcaagacctcccaccagcaaaagaactacagtttgctgaaggcttagatgatcattaacattttttagcaatagagtatttttagattaaggtatgtacattgttctttaagacataatgctacttagcactttactacagtatagtgtaaatatacttacagtatagtgtaaatatactttttatgcactgggaaaccaaaaaattcatgtgacatgctttattctgatactcactttatttcagtggtccagaaccacatttacagtatctccaaggtatgcttgcatttcttgtctgcttttatgtgaaccaaataagttataatcctctattaaatacctttcttttctgtagatacctccaaattacagaatgaagcttctgtgttttttcaacttggagattaaataatggttttaaattgaggcacatgcatatactgtaaggtatattagtctcagatatactactcagtgaatattttcttagatacatacctatatagtcgccacacagatccaagtatgccgtattcccagcacaccagaagaaatctttgttcaccctttgagtcattactaccttctgtaggtatccactgttctgacttccatttccatcaatttgttttctcgtttttcaatttcatatttctgacttctatttccatttctattttatgaaaattcaaaaaaggcaaaacaattttatttatttatggtttgttatcttttttatctggcttcatttgctgaaaacaactcctacaaaattcatccacattgttacgttatcaccagtttgttgggtttcagttctgtgtagtgttccatagtttgaatggaccacaatttatttattcattttctagtttatggacgtttggattatttttattttgagggagtagttatggataaagcttgtgtgagcatttttatacatcattttggtagacatatgtactaattttgttggctatatacaaggagtgggtttactgagtcatagggtaggtatatgtatttttaaaataattattttattttttttaagttctggggtacatgttcaggatgtgcaggttacatagataaacatgtgccatggtagtttactggacctgttaacccatcacctaggtattaagcccagcatgttttagctcttttccctaatgctctgcttccccaccctcccccaacaggccccagcaagtattgttcccctccctgtgtccatgtgttctcactgtttggctcccacttataagtaagaacatgcagtgtttggttttctcttcctgcgttagtttgctagaataatggcttccagcttcatccatgtccctacaaaggacatgatctcattccttttaatggctgcatactattccatcatgtgtatgcaccattttctttatccagtctatcattgatgggcatttgggttgattccatgtctttgctattgtgaatcgtgctgcagtgaacatatgtgtgcatgtataatatactgatttatattcctttgagtatatactaagtaatgggattgctgggtcaaatggtatttccggttctaaatcttggcggaattgccacgctgtcttccacaatggttgaactaatttacattctcatcaaccatgtaaaagtgttcctgtttctccacaaccttgccagcatttgttgtttcttgactttttaaataaccaccattctgtctggcgtgagatggtatctcattgtggttttgatttgcatttctctaatgatcagtgatgttgagctgtttttcgtatgtctgttggctacatgtatgtctttttttgagaagtgtctgttcatatcctttgtagggtaggtatacgtttaacttcagtagaaactccaagcagtttcccaagttgtaccagtgtattcacccaaaagcattaggtgagagtttcatttgcttcacattctcaagaacacttccagtgagtgaagtctttcgccattctgggaggtgtatatttgtgtatcattgtcattttaatttgcatttctatggtgctgatgatgcgcgagtgcttctatatatgttgactggccatttggatattgatattctcttttgtgaaatttctctttagatctttacccctttaaaaaattggattgtttgccttatttattattgatttatagtaattctttatattatgtattttatatacaaaacttttgtgggatatatgtattgggaatatcttctcctggtctgtggcttatctcttactgttttaatcttaatggtgtcttttagagaacaaaagttcctagttttcatgaagtccaacttatttttttctttagtagtttagtgcttttgaatattaatttacaaaatctttgcctacaggaagatcacaaagatattgtcctacattttgttctagaagttttatagatttatctttcactttttttttaggcagggtcttgctctgtcactcaggttggagtgcagtggtgcaaatatagctcagtgcaaccttgacctcctgggctcaagtgagcctcctgcctccgcctcccttgtaattgggaccactgtgcatgccaccatgtccagcaattttttgatttatttttatagaggtagggtcttaccatgttgcccagcctggcctcacactcctgggctcaaaggatcctcccgccttgaccttccaaggtgcagagtctatagctgtgagccaccacacctggctacctttcacttttagatatgtgatctagaattaatttttgttcatggtgtgcaattgggattaaggtttttgtttgtttgtttgttttactggtttacagtgctctagcaccattaattgaaaagattgtcttttcccttcagactttcagtggtctttttcataaactaagtgactgtttatatgtggatctgtttttggactctgttccattggtctatttatgcattctttggttgttgtcagactctccaatataataaattttgaagtctggtagtgtcagttctcaactttgttcttaaagattgccttggctagtctaggacctttgcatttgtatgtaatttttaggatccttaggtcaatttccacaaaaaaacttaatggaattttgatttggtttgcattgtatctatagattaatttggggaggattggcatcatagcaatattgagtcttttgaaccatgagcatgatatatttctccatttatttacatcttaaaatttttttctcaatttttagttttcagttgtagatgtctttattcattggtattttattttcttatgttattgtataagtggtgtttcataaatttcatgtttgattgttgttgttagaaatagaaatagaaaaatcttgagcttgtattaaacaaccttactaaatttgcttattcgttgtagttggtatataatcatgttacctgttttctttttgatctttatactttcccacccttttattgcctgttttcctgactataacctttagtataatgttgaatagaagtgatgatagtggacaatcttcttttctctttaacctttggggaagtattgaacattttaccaatctaataaatagattggtattagtggtaggtttgtgtgtatgtgtgtgtatattattattactattatttttggtaatagctaccttttatcagattaaggaagttcccttccattcctaggttaccaagagctttttttaaaaaaacgataaatgaatgttaaattctatcaaatactttttctgcatctattgagatgatcctagaatttctctgcttaattttgttaatgtagtgaattactttttaaaaaaattttaatttctttttaaagatgggtctcacttcactgtgcctggatattacttaggtttatttttgaatgttgaaccaacactgtattcttggaataaaccccacttgattatgtatattatgtatattatccttatatattgctgggttttctttgctaaattatcatttttatttttaaaagttttcatctgtgttcatgagagatgttagcctataattttcttttcttgtgtccatatcatgtatgcatattattaggcttatgctggcctcacacagtgcttaggaagtgttttcttctctttctattggctagaaaaatagtacaagattgatttctgttatttttaatctgtatgataatctctttttctctttttaaaatttgtgaaatagtcatcaaaatagagtatggttgtcttcttttgcagctgaagaaactgaagcttatagaatttaagtactattagatagctggtggttactgctctgtattgaaaaccagttctgttttacttcaaagcctttgctatacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgataatggtgttatttgcccaaagaacttttcttgctcaaagaactgcctatattgctttcttgctaacttgttaaagactagtatataataggctattacatagaggatgaatgcctggaaaaagaaataaaaattatgatttttttaaggaagatctctgagtttaagattttttccatgtcacattattatttctagtgatgctatagggataccgtattgcaagtaaacatctatagatgtacaaagaaaatttgcagtcttaattttaattagaaaccatttaccacatttagaagctctgattaaagatataatggataaaagggataaaattacatttgcagttatttgtttttaatctttaatgtcccttcttatatgactctcagatagagtgagcagggcccaacttgtctgaagcttaagaggtgacccagaatataattgagaggactagaaaggtatattagactattcttgcattgctataaagaaatatctgagatggagtaatttataagaaaagaagtttaattggcttacagttctgcaggctgtacaggaagcatagtgctggcatctgcttctggggaggcctcaggaagttttactcatggcggaaggtgaagtgggagcaggcacatcatatggccagagcaggagcaagagagtctggtgcgggaggtgccggactttgcaacaatcatatctcaagagaactcactcattattgcaaggatagcaccaagccatgaggaacccgcccccatgacctaaacccctcccaccaggtcccacctccaacattggggattacaattcaacatgagatttgtaggggacatccaaactatatcaaagggcaatggatcagtgtcagcattcactgctggtaaaaacagtatttgtattcttaatttggttagtctggataggagccaaagattcacagcatggccgtattcacttggaagtttgcaatttgattaaggtttgagaacatgtcagggaaggaaagaatttcctttaaaatcatcctgcacactgaatacctaaagtagtacaaataatttgttatggcctgagaagctaagaaaaaatttagtcattcttctaagtccaagaatggctgtaggggatagtacatgagtgactatcctgtctacttctgttttctgttttattttgtatattttttagaaacaggatctttctctgtcccccacactggagtgcggtaatgcgatcatagctcactgtaacctccaactcctgggctcaagctgtcctcctgcctcagcctcccaagtagctaggactacagacgtgtgccaccacacctagctaattttttattttttgtagagacagggtcttactatattggctaggctgctcttgaactcctggcctcaagcaattctcttgtcttgggctcccaaagcactgagattataggagtgagccaccacgcccaatcctgttttcttttttgaggtgcgttaaatatttacattttacctggagtttggaaaagtagtttatttggacgtacaagcttgttttttttttttttttttttttttttgagatggagtcttgtcctgttgcctgtgctggagtgcagtggcatgatcttggctcactacagtctccgcctcgcaggttcaagtgattctcctgcctcagcctcccgagtagctcggcttacaggtgcacagcaccacacccagctaatttttgtatttttaatagtgacagggtttaactatgttgggcaggctggtcttggactcctgacctcaagtgatcctcctgccttggcctcccaaagtgttgggattacaggcatgagccactgcgcctggccaaggtgtgtttttaaagtagaagttaattctgtggattgatttaaccaattttctttgcaagcaattgtataggagaattaaatacaaatcctcctactgatgtcagatttagataatgccttaatatgatgtaatatcttaaatagtgaactgtttggttataccttgtgccatgatttccttaatatatctcataaagttgtacaaagaataagattgagatgctttactgttaggcacatagacatttatgtaacattcattttaaaaaatttgaataccaattatgtgtaaggtactaggataaacacaaaggatacaagaagtctttgccttaggccaatacattctgatagagtgttaaaatagttacacaagtatctgttactcaaagcattaattacataggtgttatatatattaagtatataaacattatgtatattaagtgccttgtgctgagtatcaactaagtgttttaagatcagagtccatttggggtttgtgatggttaattttatgtgtgaacctcactggatcacgggatgaccagatatttggtcaaatattattctgagtttctatgagagtgtttttggatgagatagatggattatgagtagagcaaaaaggcagactctcccacatataagagagaattctttcctacctgactgccttcaaactgggacattggctttttacctgcctttgaacttgaactgaaacattggcccttcctgggtcccaagcttgctggccttcagatggaaactatactgccagctttcttggttcttaatgcttcagacttggactgaaactaaaccattggttctccaacttgctcccacaactctgcacatgttaggtcagcctccacaatcatgtgaactacttccttataataaaaaatctttacacacacacacacacacacacacacacacactcacacacatactattgtttctgtttccctggagaactgtaattaataaagggtgacttggaaaggcatcacagaggaggtggaatttaagccagaggctaaactatcgtataagcaggatttcagtagataaagatggtgaagaaaaacactacaggcagaggaaatagggtatgtgatggaagcagtctcaagtagtataatttggctagagttcaagatgtttctactgtttttttgcatttcagaagagttgtgggagaacaccagttttaccacaacctggctagtacttggtggtagtgtggtagtggcagtggcagtgcgcgtgtgactttttttttaaaaaatgactgtagcaggttgattgatgattggttaaagaggaagtctgctttctcagcattctggttaatctaacctgagatcatttttcattactctatcatgctccagtccaggggaggggagggttatagtcagaaaaaaagaccgtataaatgtgtatatatatgtgtgtgtcttgctatttgtattggttctcatagtttgcaaagtgaatatgatgacattcttcccttggccctatttttagcttgcttttctcttagtggacctaagttatgaaatagcaaaggtttatatagctttgaaattcatgtttttagctgggcgtggtggcagtgcctgtcgtcccagctactcagggtattgaggcaggaggatcatttgagcctgggagctccaggctgcagtgagccatgcctacacctctgcattccagcctgggtgacccagctaaaccctgtctcaaaaaaaaaaaaaaaaaaaagaaatacatgttttataccctcagatttaattgcttattttacatatttgaccatccatttcctgggatgactgatgccccaagatggtgccaatgtggaatggcagtactgtttagtaggactttctccagtgtccagtgtggtatccaccagccacacatagctattgagtccttgacatatggctagtgtggctgaaaaatggaattttaagttttatttaattttaattgatttaaatttaaattgtaacatatagctagtggttactgtatgagacattgcagttctggagcttaagaagttttggcttgtttctagctctctggtgttgagaagggctgaccaagcagtattttcactcatatttaaaatataatatcttaaatattcttaaatattctattggtgattacacagcaaatgaattttgatattgccaattcttcagtaaaattaggtatttattaattaattgtttatgttctgcctcattccaaataaagattgtatgtgaatgataggaaatgatctattaaaggtacaattattaaaataatgataaaagaaaaagagccatgtaacaaatgaagtgagaagagaagcaagaaaaggggaaaaatcaggtagcgtgatgcctccagcttttttcttttggcttaggattgacttggcgatgcgggctcctttttggttccatatgaactttaaagtagttttttccaattctgtgaagaaagtcattggtagcttgatggggatggcattggatctataaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattgtctttgaagcaattgtgaatggcagttcactcatgatttggctctctgtttgtgtgttattggtgtataagaatgcttgtgtcttttgcacattgattttgtatcctgagactttgctgaagttgcctatcagcttaagattttgggctgagacgatggggttttctaaatatacaatcatgttatctgcaaacagagactatttgacttcctcttttcctaattgaacaccctttatttccttctcctgcctgattgccctggccagaacttccaacgctatgttgaataggagtggtgagagagggcattgcgacactattaacagtagcaaagacttggaaccaagccaaatgtccaacaatgatagactggattaagaaaatgtggcacatagtgggaggagccaagatggccgaataggaacagctccggtctacagctcccagcgtgagcgacgcagaagacaggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatactgcgcttttcagaccagcttaaaaaacggcgcaccacgagactatatcccacacctggcttggagggtgctacgcccacggaatctcgctgattgctagcacagcagtctgagatcaaactgcaaggcggcagcgaggctgggggaggggagcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgagggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaaccctacaagccagaagagagtgggggccaatattcaacattcttaaagaaaagaattttcaacccagaatttcatatccagccaaagtaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcatgtgcagagacacacataggctgaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagtggacctaatagacatctacagaactctccaccccaaatcaacagaatatacgtttttttcagcaccacaccacacctattccaaaattgaccacatagttggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaacacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatctatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgagaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagagactaccatcagagtgaacaggcaacctacaacctgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcatcatcactggccatcagagaaatgcaaatcaaaacactatgagataccatctcacaccagttagaatggcaatcattaaaaagtcaggaaacagcaggtgctggagaggatgtggagaaataggaacacttttacactgttggtgggactgtaaactagtacaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccgacccaaatgtccaacaatgatagactggatgaagaaaatgtggcacatatacaccatggaatactatgcagccataaaaaaggatgagttcatgtcctttctagggacatggatgaaattggaaaccatcattctcagtaaactatcgcaagaacaaaaaaccaaacaccgcatattctcactcataggtgggaattgaacaatgagatcacatggtcacaggaaggggaatatcacactctgtggactgtggtgcgggtgggggcaggggggaggggtagcattgggagatatacctaatgctagatgacgagttagtgggtgcagcacaccagcatggcacatgtatacatatgtaactaacctgcgcaatgtgcacatgtaccctaaaacttaaagtataattaaaaaaaaaaaaaaagaaaatgtggcacatatacaccatggaatactgtgcagccgtaaaaaatgatgagttcatgtcctttgtagggacatggatgaagctggaaaccagtctcagcaaactatcgccaggacaaaaaacaaaacaccgcatgttctcactcataggtgggaattaaacaatgagaacacatggacacaggaaggggaacatcacacaccagggcctgttgtggaatagggggacgggggagggaatagcattaggagatatgcctaatgttaaatgacgagttaatgggtgcagcacaccaacatggcacatgtatacatatgtaacaaacctgcacgttgtgcacatgtaccttaaaacttaaagtataattaaaaaaaaaagaaaaggggaaaaatctaggaaagtctagtcgagggtagcaaaaaatccatctgtgtcaactggcagatagagtaaaaaaaataaatccaataaaaaaataacatttttatgtaatgagacatgccattgagtcaagagagaaactttttccaaagacgaaacaaggagaaatttattccgttttgtaagatttgttgagtagtatagtggacggcatcgtttaatagcaattttacaaataatagagacatttttatcatatatttacatcaaatcttggtaaaaagttttttgaagagctaaagcctgccaataaccatgtgagcgagctgagaagcagattctgcagagctagtttagtcttgagatgactgcagtcctggctgacagtttgattataacctcatgagagaacttgaaccagaggcactcagctaagccactttcagattcttgacccacagaaactgagataaaaaatgtttgttgttttaagctgcttagttttggggtaatttttttatgtagaagaagctaactatgttatgatattttttttagaatggaggtgcttggtgttaaatgataaatagatacagctttctaaaccttcaaatcttatttatgaaagtacatttatagccttatatgtttgagggtgtaaatatagttaggaaaaatgttgaaattaagtattttcactagccatcctaaatggcatctggccatttgaatgaatgaaaaatagctaataacaatagataacatgtattgaactctttctctgtttcagaaactatcctaagcatgttatggacattgtatcatttagtccttacagaattgtattgagtacttcagactttaaaaccaaatcactttgactccaatttagccattgtactaaccatactgtgatcaggtaacttctgaggtatagaaattcatgtgttaaacatctgagggattcttaaattttgatggatgctggagatatagtggtgagcaaagggagacagaacctcagatctcatgccacttacaacattttgaagtacatagacattaatacaataaatacatatttacagactgaggtcagtactatgaagatgagttctgagatcctttaataaaagcaagtttctggtccaggcacagtggctcatgcctgtaattctagcaattttggaggctaaggtgggaggatcgcctgaggccaggagtttgagaccagcctgggcaatatagtgagaccctgctgctacacaaatttaaaaaaaaacccattagctgggaatgatgatgcacacctctagtcctagctactcaggaggctgaggcaggaggatcgtttgggcccaggagtttaaggctacaagtgagctatgattgggccactgtactccagcctgggcaatagagtgagactccatctcaaaaaaaaaaacaaaaaccagtaaaagcaagtttttattgttgaagagcaatggtatgcttacaaactgaaagaagggcaacaaggttatagcacagaaaacaaaaagaagagtggtgtgagattaggctggaaagatatgcatgggccagactagcaaggccttggaaggtgatgttttattctacttcctaagggaagctatcgaaaagtttttaacagatattatgttaaggttttctttttggaaatatcattgtagttaaaatatggacattgtagacatgccatagtggctatggggagactcttaggaagctgttgaaataaccaaacaaaaaagatggactaaggtattggcaaaagttttttcagaaatggagagaaatagacttgaaagatggttacaggataaaatcaacaggacttggtgagaaaattgattaccagggggttggggagaaggcattgttaagaatggtgaaaagatttcctacttgcctatctgtgtgtatgatgatgctatttattaagggtacagaacattaataggaagggggacacatttggtggtaaaactcattagttagcttttgccgaatttgagatatgtttgagacatccaagtttggaatgttgagaaagatgtacaggttgaacatccctaatctgaaaatccaaaatcagaaatgctccaaaatctgaagctttttgaatgcctataagatgcttgaaggtcatgctcaaaggaaatgctcatttggagcatttcagattttggatatttggattagcgttgctcagccagtgtaatggaattatgttattctaaattctgaaatatgaaacacttctgatctcaagcatttcagatcaggatactcaacctgtattagattggatcacacagaactccaggccagagataagaatgttcaaggaatgggcaaatatatggtaattgatgtaatggttaagaatgccttgtgagagggagtgagaagagaagaaggcctagaagttgaggaactccaatattaactggccaaactgaagaggataacctacaaaggatatagtagaaggattctttcactcatttatttatttattcaacagatatttatcaagtgcctattatataccaggcacaaatatggaatccagggatatagcagggataagatagtcaagatctttgctgtcatggaacctaaactgtagtagaaagtacgtaaataaacataaatactttagataggtacaggtactaaaaggaaatagaaaaggattatgtgactgaggaagggaagactagaagaggaacaaggcttttgaggaaaatcaagaacttccttctttttagccatgctacttttgaggtatctatatccaaatccaagtgattaataggggctgctgcatgctagtaaatagcaccaccattcacccaaattggcaggctcaaacttccagcagcttttttctttctttcgttctttctttctctttctttttctttctttctttttctttctttctttctttctctttctttctttctttctttttctttctttctttctttcttctttctcctctctctttctcctttcttccttccttccttccttgcttccttctttctctttttcttttcccttccttccttccttccctccctccacccctccctcctttcctccctctgtccccctttccctttccctccccctcccccttcccttccccctccttctccccttcccttcccctcccctcccctctccctcctcctgcctattctctcccctctccctccctcccccttccctcccctcccctctcctgttctctcctctcctttcctttcctttttctctctctctttcttatactccatattcagtccattagcagctcctgactactccatctttaacatttgtgctcaatatgattacttcaattatatgcactatttctttactctaagccaccattttctcttgcctagactattggagtaacctctgttctgatctcccagcttccaatcttgtccccatataatctggtattcacattgcagcccgaatgatcttttaaaaaccaaaattctttgatcatatgctccagttgtttcctataatatcgacacagtttaccatggcaataatgctctatatgatctagtcacttttttgactgcattttggaatgctctttccctctacttcagcttcactggccaagactccgctattccttgaagatatcagtattattccagacttcagggcatttgcatttgctgttttttcacttggaatgctcttcccccatattttcacttagcttgctccctcacttcataccagtctctgttcagctgtgatcttatgaaagaggttttccctgaccaccctatataaataagccttctttgacacctgcctatcattctgtattcccttagcccatttttatttttcttcatttcacttatcatctaatatgttcttgtttattattttttctttccctctagaatgcaaagaccttgtctgtcttattaatgtctgcatcccaacagccaagaataatgcctggtatataatatgtgggttccataaacatttttttttagtgaatgaatgaatgaatatataagtctggagctcagaggagatttcagtgctgaaatgtaaatttagtagtcaatagcatataaatggtcatttacactgtaggactggatgaaattatcaagagatagtatggagccaaaccagaaaagggacccagattcaagcctttcgctgatttttcatttataaatcagattagaaggacccaacaagttaggaggaaaaccaggagagacatatcattgaaactaagagaggaaatgttctaaggacacagctttgttggataatgcttacaggctggattaagatgtgtttgtaaattaaccattggatttgcaaagatgaagattgttttgtggcttttaagagttatttcagtggagtggttggggtagaaatcagactggagtatgacaggtgaggtagggagagtgaagtagactcctttgagaagtcttgctgtgaagaacagagaattgaatgatcattgaacggaggaaatgtaatcaaggaaggacttaagtattcccccagagttttctgaatttgcaattcattcatcttgattatctccccttgaggtctagctgtcatcagttaactggaggattgattcataatccctttttgcaaggtggcaaagcttacctttctcctcaaacctatctaccaaagttctctttcttctttaatttcattagagtccttggtaaatgattcacatttctttttgttataactcttcagtaaattaagcctttgcctttcttgctgattttaccgtattatataactatcatagatgatttcaaatgttaatagtgatagaaactgtaataatataatactaacatgtattgatatttactatgtggggtcttttgaagaaatttacatttttttaacttaatattcaaaacaaccatgggaggcaggtgctattattatcctcagtagaggatctaaggatctgaggttcagagggcttaggtaatttcctcaagatcatatagttcataagtggctacaggtatgattgtagagcttttgctgttagccaccatgctattctgtctttaagttaacaaagtaaatgtttcatcttctaattatgttaaactaatatgcctttggtgaattgttttggtaaagttaatacttctttttctccacttttatatctgttatgtgaatttatgtcttagactggattattggtaactctattatttttacaataatcaaatgttagggctagatgggacatttaattacataatgaatggaataaaaatctgctaatcagatagatctgttttctaaactgcattttttctcctttgtcttttttggcctaccctgttggctgtgaactttattttaaaattcatttgtgcttataacaataataagcactatttattccttgagtggttttacaaaccttacaaggcttaccatttccagagtgtcagagtagctatagcaggtttacacttaaatatactcttggttttatgacattccattttgacagtgatgaagagcatgcttataggcatcgttgaaaaggaatgttagaactgtttatgtgatagttctacaagtttcttacatttatctattatagaaagatctatcatacatgcttacttttcacagagtttataatatatgcatatgttttaatggtttgttataaataatatgattagctggcaaaagcttttagcaatttaaattttggggttattttaaattatgaatttaaacaagctctttcatttcaggtggttggctaaacccactgtggctgatagtgttatataaagttgttttctagttttgaaaagctaaaagtttatgtttttatgctttctgtgaaagtcactaatacttgtaacctaatgaaaatgtttctactgctacaattgtggagaaattttgaaaacctagatttagtcagtatttttcatgctaacattgtaaagaatgtcagaggccatggagaggatctaagggaatcagagaaaaggaagaggaagtaacatttttagagtacattttatgttctaggcaactcagtaatagggcagtatatcatttcattctcacagaagtctttcgaggtattataatttcccttttacagatgaggaaactgaggttgcagaggttaattatgttgataaagatcatatagataagtagaactaggattgaaatctagatctacttgatacttaagcttcctcttacacttgttttatggagttgttcttgggccttcttaaacaggtaattattctatgtcatagcagaattcttgatagaattatgatatttaaatttttatttactcagctatcataaacataaaaatactatactactatataagcttgcaggtcttttgaatataaaaactaaactgcatgttgactcatttatcagagttctgtagaataattaaaagtaattataggaggtcttttttaagtgtatgtagtcatttgtattatttgaaagcttagacagcttttatagcagtttgcttccagaccatgctcattgatgcattgaagagatacccgtgaaccaccttgtctactcccatacagctgatttatctttgtagcagtccctgagttagagaatcttccctactacctctgctatagttttcagtaaattgggcaagatcaaatgtttcctggagataatttccttagctcttgtattagatcccaacagtaaatacattattgactgatgtgaacacagaaagcatctcaaactttttgttgatcagagcatagctcagttgttttaggaattccagataaaatgacagtaatgtattgtgattatttccttcttttgaaatgaacttgaatatacttttatgtttatttgtaaaataacatttcaaagatcacattgtgcttatttttacagtggcctctggctgaaagcaataaagttctgtcctgggtggaactaggctagttgcagtttctcaaatttcttcaatgagatgctttgcttttgtgaaaataagtcatattgtccactgccacctttgtttacttctccattttatcccctcttggttacagaaattagctactacaaataaaatgccaagattttataattttctatgtttaaatttgcaagtaaaaagttctgttgaaacatttgtaagatcaaactaatgtgagataaatatgactgatattcagaagttgattaatctaactttcagtactgtacctattacataaagtatgattaatctctatgtgcaagtatataaacaaattttgagtataaaatcataatctaaaattttgttttatatttaatggagtgttcaaatactttgtaataaaaacaatggatgactaaaatgattgaataagttatcaaatagagctttgtaaactagggttcatagttgcaaataatagaaatcaactctggatattttaagaactaaaaaaaaaattgaaacgttactgagaagcttacagaatcactgagagggttgtagaactaggctcaataaaaggatcagaataggagaggttaggcagcaaataggaccacaaccaaaatcacagcacatcagtctggtgaatacatgcatggctaccaccaaaaatgaacactcacttgcccctcacgttagccaatgaatgctgtctcttccactgctatctaagaacctcgatgttgctaccatcagtttccagaatggattctctgatactcccctctgcatcattatctcccagtttaaagatgggtgtttctgagtagctgacctaaggtcacatactaatactgtaactacaagaatagttgggaaagtgaggattggatattttcagattgtgtggagaactaagctctgtggtctatcaacactcctcaggtaggtaatttctaagtgtaggaaagttcagatgttgggtggccaaaaatgtacagatatccactacatttccttgtgatagcatctaagttctttccatttcattcttttataaattcttttaacattattgttgcataagagaaaaaggcataaattattttaaaattttagattcagagacttggttggacacatgatattactctggatgttcttagacgtttcaggccatttcaaccttattttagttattactttaacaagtttctgcaaagttgtggttgtattaatagcaaacatactaatagtgctatttgagcattatcagatatcataaacatagtattctatcccttcttctgaaagatatatcaacatttccctagatatatccttatctttgtactcactttggagaatgagctctaaaagtataatggaaggaacaaaaactttagagccagatttgggatcagatgtgacctctgtcactctgtcatcatcatttggtatctaacattagcagttattctcattttagatatgataaaactgaatcatagagaggttaagtagctcaagacttttaaattaaacatgaacgattaaacattaaaaagtatccagaaaaattaacttactttttttctaaatgtagtataaatatttttagtgcatctcaagtatgcagtgacttagatacccatattccaattacagatgtctaattttttaacttacatacaggaacaggtaatcatgttagatcagtttgtctcagttccttgtgttttatgtttagaatgttggggatattttgttcatattctaaataactatttgttatacccttccaccatcatttaatatgttaaagttttaaagcattttactttgatttttttttttttttttttttgagacagagtcttgctctgttgcccaggctggagtgcagtggcactatctcggctcactgcaagttccgcgtcccgagttcacgccattctcctgcctcagcctcccgagtagctgggactgcaggtgcccgccaccacacccggctacttttttgtatttttagtagagacggggtttcatcgtgttagccaggatggtctcgatctcctgacctcgtgatctgcccacttcagcctcccaaagtgctgagattacaggtgtgagccaccacgcctggcctttactttgattttttaaccttacaacaccccttgtacttgtataatgtcatttttacagatgtgggaaattaggaatatagattaaaaatgacatagttataaggctatagtttagttctcacagagaaactcagtcatataagttaagcgtttttgttcccaaatgatagtcatagtagtaaaagaaatttttaaatttcacttatttattcagaaagtgcttactgagcgcctagtgtgttctgtgcactgacttaagtgctggagatacctaagtaaatcagacgatttctgctgtcatggagcttatacacttatagagggaagtagaaaataaatgtaaaaaatattttcaccttttgataagtaagtgctgtggaggaaaattaagcaaggaagggtaaaggggaattctaggggttaggaaaggggagttataattttaaacagaattattgaggaagacatcactaggaaggtgacatctgagcaacaaaagacctaaaggaggtatgggaaggagacatgcggatgtcttggagaagaacattataggtagagagaagagcgaaagtccaaggccctgagaatgcagcatgtctgacacgttcaaggtgaggcaaggtgcaggtggggggcagtatgttgaaagcaaggtaagcaaagggaagagtaaaaggaaatgagatgaaaataatgaaaaagcatacgaaagcaagtgattttttcttgggtctagatttcatactggtacctaactttgcttaatttttctgttgttaataggagctgttaatgcccagtcaatatatcagagaatggagtttgagcaactatagtttaatgaggcaattaaattgagaaccgtggctttagactagttcaatatgaagaacagattaaatgtactctgaggaactgccttttaattatagatttttgagattcattttagtgtcatttttttcatggttaaacaacatggagaggaaagtaatgatcttataaaatagaagtgttcaagataacttactaggatggatcatctgtgtttgccaaatcaaacagggcaatttaaaatacagttgttccttggtatacatgggagattggttccaggactcttgagtatatccaaatctgcacatactcaggtcctacattagaccctgcagaacccacgtatacaagtttcacatcctgaacttactgtattttcagcccgtgtttggttgaagaaaagccatgtatataagtggacttctacagttcaaacctgtgttgttcaagagtcaactgtgtatcaggttagcatataaacctgttttgttttgcctaccataaaacactgatctttagattgatacaattgctgttttattcattggttcatatacacctaatgagattgctattttaattttcattgttaagacacacttaaattcctaatacttaaaaacgtatatgaaaaatttattttcacaaatcgatatacctattttttgaacagtagtatgcatattgctttacaaaatgacagtgtaaaaatggcattcagattcccgtttctaagatgcttgaacattttgatttttactcattagaagtttaattgttattagtcaacaaggagaaacaatgaggaacttacagaggagtgtcagttgtattgaaagattaggagtgaatgttttatcttgtaaaaagatatctcagcccctaggatggtctacagaaatgacaataagctccgattcttattttaattttttattttttctgtttctctgtctcctgtcttttcctgcgcattctctcttttactcccaacctctcttgtttatttctttggatccgtcaaagttggaaattgaacagtatttctgatatattatgtagtatgagttctgaaatcttggtgaattaaattcatgaatgctaccatagtgattttattaaggtgtggcttttgattacatgttcttcaagctagggttatgggagtcagctagtaggtaggcttagtttgattgtcctactttaacatttgtttttccttcttgaaataactttcatgaagttagatacaggcttttgtacaggatcattttgtgggaaatggtgggtctgaaaagtaagccattggtattgataaaagcagagagaaaatgaaaaagaaaaaaggtaggaaagatgtgccttttagccaataaatagaagtttaaaagacatgaaagaatgagatgtaatttttttaggagctctaatttagccatgaacacagccaccattactctgcagaaagggaaaaaaaggggattctgtttcagaatttgctgtattaaaaactatttgagaaagagaacactttattgaaaattgaaaattattggctaacattcagtgtgagggtatgtcgaagtaccatccgactaaaaacaaattaagtgtagtcgtgagtcaaacatattgtttcttccaaaatttaaattaaattagtttcatatgagtgttttctttttttcttgagacagggtcttgatctgctgcccaggctggagtgcagtggcatgatcacagctcactgtagctttggcctcccaggctcaagtgatcctcccacttcagcctcctgagtagctgttactacaggcatatgccactacacttggctaatttttaatttttttgtacaattgggggtcccactgtgtttcccaggctggtctggaactcctgggctcaagcgcctccagcctccagctcccaaagtgctgggtttacaggcatgagccactgcacccagccaattttatgtgttgataacaatcttgctgaacttactgtttcttataacttataggttgttcttcttgggattaccaagtaaatgtcctttgcagtagtgacactttttctttcttttcaatctaagattttgcttttttctctgattgtgtaaagttagcacttctaaaacaatactctcagcatgtattgcatgattacatactttttcttcttatattaataatatgaagtatattaattgaatgctcaatattgaattaatcttgaacttctggaatatgtcatataattctattcttttaaatgagttattatgaaaaattttaaccatacagaaaagttgaaatttattcggtggaaatctgtatatcctctgtcttaatttaacaattaacattttgctatatctcctctttttttttgttagaccacttgaagctgtttttgagaatacagattccaatacaaccacaaaaaccttaccacatctaagaaaattaatactgattctatcttatgtaatatctgttctttatttaagtttcccgaaatatccccaaaatatcttttatagctttcatttttttccaaaccaggcaaggtttatacattcattgcatgcggttatgtctctttcatctctttcaatctagaatagcccaccccatcatcttttcttctgttggacagttatactaatatgcagagatgatgtcatatttttcactacagaaaaagcactcataaatatgtataaatgtatatcgatcataatgcttgagaaggaatgggcattggacccatacctctgcactctggcttgaaggaagatgaaaagtttctagatacaacagaggaaatgataatatagagaagtccaggaggtacaaagtctgtgtgacaaagatagaaagtagaggaatgtgatacaaagggagaaataaaacctttgaatcttggagctatataataaatgttaagattcttcatactgaggttgtgaagcaggacaatagtgaagaggaatactgaagaaattataggagttttaaaaatgattacaagatatatcctatatagagagaatattacaatttctggtgaaaactatcaaatataaggggatattctccagaacgaaaaggtgaaagaaaacacctcattggcactatgtagaagaaatgggttgtaattatccaccactgcacctgccagccacgaatggctgtttaaacttcagttaaactagttaaaattacataaaataaaaaatctagtccctcagtcacactgaccacatttcaagtgctcaatagctatacatagctagtggctccatattagagtgttttcatcatcgaaaaaagtttaactggccatcactgcaatagattcaatataaaggtatgctggcttttagggtacacattcaaggtttggtagggagcctattaaaactgatcaaaatccttgattgttatttagtctggatgaatcacataggggataatgacagtgaggaagagaacacggaagcatatttagagtcctcacaaaaaatctggatgtgctgggaataataggttgtgtgtgtgtgtgtgtgtgtgtgtgtgtgtgtgtgtgactccttattgttgattgacacagtggaacaatgaaggaagatagtagaagacaagtaatctagttttacctgtgctcttctctcttgcaaggtagaaggctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctacaagggagttaaaagctggttgaagtgagtgttttgggggttttctgtgaattaataattttgaagaggaaacagccctggtgcgtggggcacattttcgtagagaacacaaagaaaagaaaacctctttggtacatattttctttcagtatttttgggcaaggagaatgatgtactttttactgacaagagtataactaaagttgccattaacagaaataaagcccagttatcataaaggaactgaagtccaagattaaagaagattatagaaaagtacttgattgattgttcataaacatattcaaatatcccaatacagatgaattttgtcctagggtattgagataacttacaaaggagattagcaaacagactatatatttttttaagacactatagagaaggagagaggttctggaatactggagatagatacatgccattctgattttcagaagggagaaatgaaggttccacaaacaataaatcaattggtttgacattgaccttagaaaagattaaaggggtgggttttgatcatctgagagagatagtagtggtcactaagaaaagattaaagaagtgggttctgaacacccaagagaggtagtagtggtcattaggagttagtatgggctcatggtgcataattgtgacagattgacttttcaagtccaccatgtactagctgtgcaacattgagtaatttgcttcatctatctgggtctcagctttcttatctttaaaatgaaaataaaaataatatctattacataggctcgtaataaagaataaatgaatttacatttgtaaaacatttagaacgaaatgtgatacataaaaagcacaatgtcagtgatagataaatagctagagagagaccaacaggctgccttctttttttttttttgagatggaatctcgctctttcacccaggctggactgcagtggtgcaatcttggctcactgcaatctcggcctcccgggttcacgctgttctcctgcctcagcctcctgagtagctgggactacaggcaggcgccctgccactatgcccagctaattttttgtgtttttagtagagacagggtttcactgtgttagccaggatggtctcgatcttctgacctcgtgatccgccagccttggcctcccaaagtgctgggattacaggcgtgagccactgcatccggccacaggctgccttctttaatcaaacttgtagctccgtgaaatgaaacagctaatgtgcaaagattgtagcagctcttctttaaaaaaattgaggtgaaatttgcatagcctaaaattaaccattttttttattattatactttaagttttagggtacacatgcacaatgtgcaggttagttacatatgtatacatgtgccatgctggtgtgctgcacccattaactcctcatttagcattagttatatctcctaatgctatcccttcccccctccccccaccccacaacagtccccagagtgtgatgttccccttcctgtgtccatgtgttctcattgttcaattcccatctatgagtgagaacatgcggtgtttggttttttgtccttggggtagtttactgagaatgatgatttccaatttcatccatgtgcctgcaaaggacatgaactcatcattttttaaggctgcatagtattccatggtgtatatgtgccacattttcttaatccagtctatcattgttgaacatttgggttggttccaagtctttgctattgtgaatagggccacaataaacatacgtgtgcatgtgtctttatagcagcatgatttatagtcctttgggtatatacccagtagtgggatggctgggtcaaatggtatttctagttctagatccctgaggaatcgccacactgacttccacaatggttgaactaatttatactcccaccaacagtgtaaaagtgttcctatttctacacatcctctgcagcatctgttgtttcctgactttttagtgatcgccattctaactggcgtgagatggtatctcattgtggttttgatttgcatttctctaatgaccagtgatgatgagctttctgtcatatgtctgttggctgcataaatgtcttcttttgagaagtgtctgttcatatcctttgcccactttttgatgggttgttttttcttgtaaatttgtttaagttctttgtagattctgaatattagccctttgttagatggatagattgcaaaaattttctcccattctctaggttgacttttcacttcttttgctgtgcagaagctcttgagtttaattagatcccatttgtcaattttggcttttgttgccattgctttttgtattttagtcatgaagtctttgcccatgcctatgtcctgaatggtattgcctaggttttcttctagggtttttatggttttaggtcttacgcttaagtctttaatccatcttgagttaatttttgtataaggtgtaagaaaggggtccagtttcagttttctccatatggctagccagttttcccaacaccatttattaaacaggatatcctttccccattgcttgtttttgccaggtttgtcaaagaccagatggttgcagatatatggtattatttctgaggctcctgctctgttccattggtcgatatctctgttttggtactagtaccatgctgttttggttactgtagccttgtaatatagtttgaagtcaggtagtgtgatgcctccagctttgttctttttgcttaggattgacttggctatgcaggcccttttttgggtttcatgtgaaatttaaagtagttttctctaattctgtgaagaaagtcaatggtagcttgatggggatagcactgaatctataaattaccttggacagtatggcccttttcacaatattgattcttcctaaccatgagcgtggaatgtgtttccatttgtttgtgtcctctcttatttccttgagcagtggtttgtagttttccttgaagaggtccttcacatcccttgtaagttggattcctaggtattttattctctttgtaacaattgtgaatggcagttcactcatgatttggctctctgtttgcctcttattggtatataggaatccttgtgatttttgcacactgactttgtatcctgagacttgcagaagttgcttatcagcttaaggagattttgggctgagatgatgggtttttctagatatggaatcatgtcatctacaaacagagacaatttgacttcctttcttcctatttgaataccctctatttctttctcttgcgtgattgccctggccagaacttccaatactttgttgactaggagtgctgagagagggcatccttgtcttgtgctggttttcaaatggaatgcttccagtttttgcccattcagtatgatattggctctgggtttgtcataaatagctcttattattttgagatacgttccatcgacacctagctcattgagagtttttagcatgaaggggtgttgaattttgtcgaaggccttttgtgcatctgttgagataatcatgtggtttttgtcattggttctgcttatgtgatggattacatttattgatttgtgtatgttgaactagccttgcatcccagggttgaagctggcttgattgtggtggataagctttttgatgtcctgctggattcggtttgccagtattttattgagaatttttgcatcgatgttcattaggtatattggccaaattttcttgttttgttgtgtctctgccaggttttggtatctggatgatgctaaactcataaaatgagttagggaggatttcctttttttctattgattggaatagtttcagaaggaatggcaccaactcatctttgtatctctggtagaattgggctgtgaatctgtctggtcctggactttttttggttggtaggctattaattactgcttcaatttcagaacttgttattggtctattcaaggatttgacttcttcctggtttagacttgggagggtgtatgtgtccgggaatttatccatttcttctagattttctagtttatttgcatagagatgtttatagtactctctgatggtagtttgtatttccatgggatcaggggtgatatcccctgtatcattttttattgagtctatttgattcttctctcttttcatctttattagtctggctagcggtctgtctattttggtaatgttttcaaaaaaccagctcctggattcactgattttttgaaagattttttgtgtctctatctccttcagttctgctctgatcttagttatttctggtcttctgctagcatttgaatttgtttgctcttgcttctctagtacttttaattgtgatgttagtgcatcgattgtagatcttttctgctttctcttgtaggcatttagtctgtaaattcctctctaaacactgctttggttctgtgccagagattctgatatgtagtgtctttgttctcattggtttcaaagaatttattcatttctgccttaatttccttatttacacagtagtcattcaggagcaggttgttcagtttccatgtagttgtgcggttttgagtgagtttcttaatcctaagttctaatttgattgcactgtggcctgagaaactgtttgttatgatttccattcttattcattttctgcagagtgttttacttccaattatatggtcaattttagaataaatgcgatgtggtgctgagaagaatgtatattccgttgatttggggtggggagttctgtagatgtgtattaggtctgcttggtccagagctgagttcaagtcttgaatttccttgttgattttctatcgtattgatctgtctaatattgtcagtggggtgttacagtctcccactattactgtgtcggagtctaagtctctttgtaggcctctaagacttggtattatgaatctgggtgctcgtgtattggctgcatatatatttaggatagttagctctttttgttgcattgatctgtttaccattatgtaatgcccttctttgtgtcttttgagctttgttggtttaaagtccgttttatcagagactaggattgcattttttttgctttccatttgcttggtaaatattctgctatctttttttgagcctatgtgtttttgcatatgagatgggtctcctgaatacagcacatcaatgggtcttgactctttattcaatttgccagtccatgtcttttacttggggcatttagcccatttacatttaaggttaatattgttaagtgtgaatttgatcctgtcattatgatgctagctggttgttttgcctgttagttgatgcagtttcttcatagtgtcgatggtctttacaatttggtatgtttttgcagtggctggtactggttgttcctttccatgtttagtgcttcctttaggagctcttgtaaggcaggcctggtgatgacaaaatctctcagcatttgcttgtctgtaaaggattttatttttcctttgtttatcaagctttagtttgactggatatgaaattctgagttgaaaattcttttctttaagaatgttgaatattggcccctactttcttctggcttgtagagtttctgccgagagatccgctgttagtctgatgggcttccctttgtgagtaacccaacctttctctctggctgccttatcattttttccttcatttcagccttggtgaatctgacaattatgtgtcttggggttgtgcttcttgaggagtatctttgtggtgttctctgtatttcctgaatttgaatgttggcctgccttattaggttcaggaagttctcctggataatatcctgaagagtgttttccaacttggttccattctccctgtcactttcaggtgcacaaatcaaacgcaatttggtcttttcacatagtcccatatttcttggaggctttgttcgttccttttcattctgttttctctaatcttcttgctttatttcatcaagttgatcttcaatctctgatatcctttcttccacttgatgagttcagctatcgatacttgtgtatgcttcatgaagttcttgtgctgtgtttttcagctccaccagatcatttatgttcttctctaaactggttattctagttagcaattcatctaaccttttttctaggttcttagcttccttgctttgggttaggacatgctcctttagctcagaatcgtttgttattacccaccttctgaagcctacttctgtctgtcaaactcattctccgtccaattttgttcccttgctggtgaggagttgtgatcctttagaggagaagaggcgttgtgttttttggaattttcagcctttttgtgctggtttctccccatctttgtggatttatctacctttggtctttaatgttggtgacctctggatggggtctttgagtggacatgcgatttctttctgcttgttagttttccttctgacagtcaggcccctatgctgcaggtctgctggagtttgctggaggtccactccagaccctgtttgcctgaatgtcaccaggagaggctgcagaacagtaaagattgctgactgttccttcctctggaagctttgtcccagaggggctctcactagatgccagccagagctctcctgtatgaggtgtctgtcaactcctgctgagagatttctccgagtcaggaggcacgggggtcagggacccacttgaggaggcagtctgtcccttagcagagcttgagcgctgtgttgggagatctgctgttctcttcagacctggcagacaggaacgtttgtttgctgaagttgcacccacagctgccccttcccccaggtggtcccagggagatgggagttgtatctctaagcccctgactggggctgctgcctttatttcagagataccctgcccagagaggtggaatctagagaggaagtctggctatagtggctttgccaagatgaagtgggctccacccagtttgaacttcccagcagctttatttatgctgtgaggggaaaaccgcctactcaagtctcagtaatggcagacaccccttcccccaccaagttggagcatcacaggttgacttcagactgctgtgctggcagcaagaatttcaagccaatggatcccagcttgttgggctccatcagggtgggatccactgagctagaccactgggctccctggcttcaactccctttccagggtagtgaacagttttgtcttgctggtgttccatgtgccactggggtatgaaaagaaactcctgcagctagctcggtgtctgcccaaatggctgcccagttttgtgcttgaaacccaggaccctggtggcgtaggtaccagagggattttcctggtctgcaggttgcaaagactgtgggaaatgcgtactatctgggccgcaatgcaccattcctcacggcacagtccctcatggcttcccttggctaggggagggagttcctcaaccccttgcacttcctgggtgaggagatgccccaccctgcatctgctcgccctctgtgggctggacccactgtctaaccagtcccattgagatgagctgggtacctcagttggaaatacagaaatcactcaccttctgcattgatctctctgggagctgcagaccagagctgttgctattcgaccatcttgccagccactatcaaagagattagttttatattgttgagtgttcttagcacctttgttgaaaatcagttgaccacagatatataggtttatttctcaattctcagttttattccattgatctacatgtctgtctttatgccattaccatgatgttttgattactgtagcttttataatcagttatgcaaccagctatgtgagtcttatactgtttcttttttcctttctattcttttttctttgatttggttattcaatgttcttaaaattctgtatgaattgtaggatcagttttttcatttctgcaaaaaaagtcattgggattttgataggaattgcattgcatttttagtttgctttgggtgatattgccattttcacaatattgtcttccaagtccatgaatgtgaatgtttttccatttagttaggtcttctttactttctttcagcaatgttttgtagttttcattgtcaaagttttgtactgccttgattaagtttattaccaagtattttattatttttgatgccattgtaaattctgttgtaaagatggattatttcatctatatctcccatctcagttctttctcttaagatcccaatgtgcatacacagagaataaaataaattgagtagtagatttagttctaagcatcctgaaaggctggcaaaaaggaaatgagatagggaagcagggtcagtgtatgtgactttctaataaaagagaagaacttttttctggaactcaactctaggagaaaattattatgagaacttttgcattagggacatgaaataacattataaggataattttaatgttttataggaaacatatttttaatattgacaatgaataaaagcccaggggatagggttataatttagctcagtcatatagtataattgttctttaagtgtttatcctttttgttaatttataagctctgtgaaaatagcttttttgtttttttgtttttattttatagagacagggtctctctatgttgcccaggctggtcttgaactcctgagatcaagcgatcctcccacctcggcctcccaaagcactgggattataggcgtgagccactgcaccagccgaaggtagcttttttggagggagactgtgttttgttcttttcacattccctagagcaagtgcctcacaagctgtttacaaaaataatttttttctgaattctgtaattaaatatctgtgaaatttataaactgactttgaaattttagtggttctttaaaatgttatttcttgattcagagaaagaatactgtatctggataatcacttatttttaaggttttggttttttgcttgagtcttgtttgtgatctaactatattgattaagttattatacatacacacacacagcagatctaatatggcatttttttttaaccacgtacttttcttgttcctgttgtggatcaaccattatttctttgtatttagctacataaaaaaaactatcaagaaatatataaaaatgtacttttagaagtattgatttctgctcaccatcatttgtcaactttgatgttagacagctactagttagctggaattcagtgccaaatgaagtcagaggtggataggaatcttttattatgtatattttttttattttccttctccttttatttttcctcctttcctcgctatactttttcccttcaccattttttttccaccctccctgcctgtgcccatctaaagtacatacaaggattgtttagcctgtttgacaggaaaaggaaaagaattaatgtatattggctggattctcttggaattttgtgagatcagggacctgaatctgaatcaggtaacatccatgatagttattccacatccccatttgctatctgattcagattcaggtccctaataacatagcatccatgatagttattccatatccccatgttctatgttatgttgtccagctcttcccttcaggactgaaagatttatttccccagctgctaggaagattgtccactgacaggtctcatcaggaagccctctcataaaattgttgaaatgtctaacgagagcctgtcttggccaggtgccaccgcactcatgcctgtaatcccctcactttgggaggccaaggcggatggatcacttaaggtcaggagttcgtgaccagcctggccaacatggtgaaaccctgtctctactaaaaatacaaaaattagctgggcgtggtggcattcacctgcaattccagctactcgggaggctgaggcacaagaacccaggaggcggaggttgcagtgagccgagatcgcaccagtgcactccagcctgggtgatggagtgacactctatctcaaaataaaataaaataaaaaataataaaataaagctgtctttaaaaagctaatgccctttttctagggcagctcacattaaatgagttgttgatttgatgctgtaaaggcttcaccctctctcaacccaatttaggacaactctgaagggatgtcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatacgaggatcctttcgatggtaattttggaagatcctatttgaaatagtgatcttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaacaacataatcttttaaacaacacagtcatcaccaaggggatgatgctaacccattcatgaaggatccagccccatgatctagtcacctcccagcaggccccaccttcaactttgggaatcacatttcagcatgagatttggagggataaacatccaaaccatatcagtcactctgttttgtttcagagtgaatgatacttacagaatcatagtattgtaaagccctttgatttgccacttttgactagacttacacaacataacacaaatatcaaagcctcaacattgtaaaaaataatataacatgaaagtgagtgagtactaggaagagtaagtgctgtcatgtctttctcccatagagaagacagtcagaagatagcctaaacagaatctgttattcattgtggttgactccaggggatagggacaaagggaagtgtatagttttcattttaagcctttatgtgctgtataaagtttttaaagaagcatatcgtgtgcataatccctaaaaaatcaagcaaccaaaatgtagtggtgatggtgggatgtgtgtgtattgggggagggaaggaggggagaatggcttaaaaattaattcatttaaaatatttcttattttttaacttccatattttgaatcaaatgatttgcaaaaataatggattgttttataaacgcatgtaatatacatatttaagtagcaggtgtttcataaataccttgttatagaagtgcacacatttctgtgtttcagaattcaaaagcccctttgaagaaatagtcactatttgacttaccacatacgtaatgacaagaaatttacaagtataattagatttttagtgattaaattgtgcatataataattttaccaacatagtatagcatttcctttagcatttattatattgtaaatgagtgttataagcgagttataacctaaattctttaatgtaacctagttctttaacataatctaaatggtttaacataggcataggcctataatattagtaagaatagatcatatggtttagaattattttaaaatgttgaggattacttcagatcttattactgtaattccctatttgtgatgggtagccgttctgtgacctattaattgttctcttggatatgtagctgtttatgtttcagattggctgcagctgttttgatttgaggcagatggcctgaagaagcagcattcataaattaaatcacaattttttttctatgtatttttaaatcattctcagaaacctgaagtcttttcagtacagagttaatttcaaattcataatattctttgaattttcacataatatattaacttgatttttgtataacaatattcttttcatttttgtgaaatacataattgctaacttattttaacatagacatgagctaaagagaccctaattatatttttacacaaaccttatacaattatttaaattctgacccaaatagcagaatggttattacactgattctttaatcatttcaaaataggaacaattatttccaatggaattctcactttctaacttatttagttctctttttcattcattatggttttggaaagtatctgagacagctacatttattaactacactatagttaaggtaaaaagataatggtctttctcgtcattgttgaaatacccatactaaaatgatactattaaaaaaagagctaacttccttttaaggagtggtctatagcctttctcttttctttcttttttttttttttttgagacagagtttcgctcttttgcccaggctggagtgcagtggcgcagtcttggctcactgcagcttccgccgcctgggttcatgtgattctcatgcttcagcctcccaagtagctgggattacaggtatgtaccaccatgcctgtctaatttttgtctttttagtagattcggggttttgccatgttgctcaggctggtgtcaaactcttggcctcaagtgatgcacctgcctcggcttcccaaagtgctgggattacaagcgtgagccatccacgcctggccaagaactttctatttttgtataaaactttttttttaaacatagattggtacatatgtaaatgaaaagtaatattcatgtagaaagagaagtgaagatcatctagtctggcctttcagtgcttgaatttccttaaacacattaactaaatagtaagctagcttatgcaggtactgatccaatgatgagtaactctatacctctgaagataatacattccatctttggatagcattgactagtgaaaagcaaatagttatactgaatcaaagtcagcttccttgtctttctttttgtttttaacctgttggccctagattctttggggctacacagaacggtttaagcagtcttccttatgacaatcataaaatatttgaggacagcttttatgactccacaatctctcttaccattcctgaagtttcttctctaaataaatacttttggttccttcagccattcttcatatgtcacaaaggccttctctgttattcagaatatactgcagatggtctctactaggagcagaatccatgaataggattcaggaaacccatggattttgatattagtcagggttgtccagaaaaatagaaccaataggaggatatttacacatgcacatcctcctatatcccataaatatatatatatttatttatatatatttaaaatttatatatttatagatttaaaataaatatatcccatatatatatatatgtatctttgtggaagctgagaagtcccaagatctgcatttagcaagctggagaccttggagagccagtagtgtaagttccaatctgaaagctggtcagcttgagacccaagaagagaggatgtttcagtccagttctaaagctggaaaacaccagtgttgtagctcaagctgtcaggcaggaagaattcctcctattcagccttttggttctatttaattgattgaatgaggtccaccagcagtagggaaagcaatctgctttactcagtgtactgcttcaaatgttaatctcatccagaaataccctcctagatacatacagaatagaataatgtttggccaaatgtatgggcaccttgaaactcagtcaagttaacacataaaattaactatcacaaatatgaaaaatttgtatccttatatttactaacttctgaatgagagtttatgattatttcaaatcataaatttgaaaatttatgattgtaagcaacagaccactatagcaaaactgtggcttcacaacagtagaaatcacagataactttatatccactatagttgttgcagatatttggaaatattgacattcattggttcttaatgtgaatattatatataatttcctaattataagaacatatattattgaatcatgtttattttaataatatttataatgtagatatgatataaattttattgactgattggttttctctgttttcttatgcattaaattttatgcttttaagaatattattttgaaaaggatccataggctttactagactgcaaaaggggtccattgttcaagaagtggttaagaacctttggtctatactttttctaaaagtgtaattttagaaaggaatacattttatgggtgtggcccattaacactgacataggagtagagattattatctccctgcatctacataaaataaaccaagatctcattcattttttttaggcagccagactgatcacactagttggaattagtccatcttttgattctagcctggtcttttcagaatcactctgttagtgtgttccctgttctacgtttctgtcatttacaaatacaataggcatgttgtctatatcacagattaccaaacctggctgctcatcagaatcatctgaggagttttaaaaaatagatttttagttcctccctcacatttagtcagaaacattgtgcacctggtgattatgcaagctgcctggcactgttctgtgaattcatatttggaaatcccattttttatataatttatgtcatttatagtaatatttttaaaaatgttatagaagttagaattttgtagtgttgcacttgctaagtctttccaggttgacctgcagcaccctggaggttccaatgattattactttatatcattactgtaattcattcttttctgttttgaatcagtttgtttcaagaaattgagtgcatctacctaatttctctgatacgccatctaataataaatcttggcaaaaaaggaaattgtcactcatttttctagtgagttgatataaacttatactaatcactacctcttcacctgatttgtcataaattattccttaaaacttgtttgtaatcagttgatatcagccgtattgttttggtttaagtttccctaaaagtcaagcatgaaacaaggacagtagtttatttgggaagtgatcccacaaagtgggaataaggaagtggtcaagagtgagacagggaagaaggaaatgccaatataagactatagtattgtagtggtagttttgacagcagaaactagattctgctgtgacatcctgaaaagtgttcagaaagcttcctagactttctatctgaaagataggcaacgagatttatctatcagctcttgttctttattggtcaaagattccctccatcccttaacctgggaaagttaactcacccatatttccaggctgcccttgctaacaggctgagtgggacattgtagtgccagtgaaaatcctgggacagaaagtggaaagatggtgaatgcatctttgaagtggcagtctgttaatgtgaggtaaatcttttcaggaaggttcaccacaagtatgacaaaaagtggactgagggactgtgacatgggttatcagtggtacttgctacactcatcttctgtattctaagaaatctacttttttatttttataaatcaattacatttgtttgtttctaagagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatacttgaattttaatgtcgaagttaaattgaatgccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccatctcttttaaaacaaacaaacaaacaaaaacagctatttttaggtctcttcatcctttattatttttatgaatgtcgccattatcttttgtgtctgctcagatttgaactctataggctcttttggctttgctccccttcttctctttcatgccctcttcaaaccaggaagttgcacagtcttggaaggacaatctctgtaatatttctcccattatctgttgtactttttgagctcaggactgagattgaaatttttctgaatgagaagaaccaccctcaaccacgattactgaacactgagtgactttggaagttaacttttgctgcagacttgataaatccatcctaaagttacaaggaataacagtttaaatgcaaaaatcatgttatagtaaaagtcattttgatgacaatgaatgttgtttgagtcacaagtaatgtcaagccactgtatatgtcacatcttgtcaaaagttaaaacaagaagttagatgtccattcccacacaaatttatggcagatacattttctagataaaattatagttctagcagcagttttcaaactaaaatacaagttagggattttccgtatttcaaaatctgtttaactgtgcaatcaaggaacttccaggtaactgtcaactggaaatgattatttacagtgtaatgacctgctaaaagtcaggagaagaatctaatagaattttataaataccttgtaagtgaggaatatacttaaataaaataacgtgcctgtggactggtatcaatatttggcagtgcttgtctgcgtgaaaagacattttcaaaaatgaaatatgtaaaatctcattacagatgaacattaacagataaacgttgattttgatgatagagaacaccagctttgagtcccaattaaaatgaaatactctttccccaaaagaattccattcttctcattggaagacccacattacaaaacattatattcacattattatattttgaattttgtcgataaaaactttatggaaatatatttgtattgtactaggtacctacataataaccttgattttgtctcttgggcattaaagtctaaaatatttactatctgacccttatatacaaagtttgctaactgtgagctaaacaattattcattcttttaagtgagctcatacctatcaaacacagagaaataagtctctactggtagagtttcaactattagtgttgaaaaaataattctacatcattcccagaacagactttagatgattatttactccaacttaacccattttacaattattttacaattaagaatccttattttacaattaagaatccaaggtttaatggaagctaaacattggtataactgaaaatggaactgagatattctcattttccatctagtgttctttctagtgaactttatttatatgcaagtgtttctgctggatactaagaatgataaaaaagaaatatgagaaatggtgtctatatcaagatatattataatctagttggggagtgtatcagtcagggtcccagcaagaataatacactccaatggactagttgagggtcatttaatgacagactatttataaaagggtggagagagttttgggaaataggcttttgccatcgaagcctaaagagacaaggggtggctataggagaggcccctcaagaggagctgtggcttttggtggaggaatccaactactgtcaacccacgctgtccagaaaggaggtgataccccacctacaaataccttgacctcattctcctcctgccctttcatctcctgctggtgcctcccgtagtcctaatcctgccaaaagccacatggcaaataacctttggatggagtccaaaaaggttagtctcctaaggaaaactgcgagttagagagtggatctgaagggacaaatggagaatatccacctcagagagcaggattacttgtatggtaatagcacatggtaacatattctaagtgcatgagcaatctggactacatatacttaatagcatactgacacacaagatatcattttaagtgcttattttttttttttattatactttaagttttagggtgcatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcaatagtttactgagaatgatgatttccagtatcatccatgtccctacaaaggacacgaactcatcattttttatggctgcatagtactccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgctgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccacttgttgatggggttgtgtgtttttttcttgtaaatttgtttgagttcattgtagattctggatattagccctttttcagatgagtaggttgcgaaaattttctcccattttgtagggtgcctgttcactctgatggtagtttcttttgctgtgcagaagctcttgagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccggtttcagctttctacatatggctagccaattttcccagcaccatttattaaatagggaatcctttccccattgcttgtttttgtcaggtttgtcaaagatcagatagttgtagatatgtggcgttatttctgaggactctgttcttttccattgatctatatctctgatttggtaccagtaccatgctgttttggttagtgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttcttcttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatccttctcctgcctaattgtcctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatacgtcccatcaatacctaatttattgagagtttttagcatgaagggttgttgaattttgtcaaaggctttttctgcatctattgagatagtcatgtggtttttgtctttggctctgtttatatgctggattacatttattgatttgcgtatattgaaccagccttgcatcccagggatgaagcccacttgatcatggtggataagctttttgatgtgctgctggattcgttttttccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgactggaatagtttcagaaggaatggtaccagttcctccttgtacctctggtacattttttaaagtacattctttatctgcacaacaagtttaaatctgcaccacattcctttttacactgacatctggaacaaagttcagtctaattgtagttcagtagtagttcagttctaaattggtaggccacttctgctgctgcataaagttgttccactgtctatcagaagtagtttttttttttttttttttgagacagagtcttgctttgtcgcctggttggagtgcagtggcgtggtctcggctcactgaaacctccgcctcctgggttcaagtgattcttctgcctcagcttctagagtagctgggactacaggtgtgtgccaccacgcccagctaatttttgtatttttagtagatacagggtttcaccatgttggcccagatggtctctatcttgtgaccttgtgatctgcccgccttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatagattttgtagttagagaaaccacagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagttcctgtactgacatatgtgctgccagcctaatgggttacttagttatcctcattgaccatcagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttataagtataggataccatgatgatccctggggaatctgattttttttaacagacaagaggttcccagttttcatttttaaatcaagttgctatggggctagcatctttgtttgcttaattttaatcacaattaccatgacaaaacttatttatttagctaatgcctaacagtgtcaaatgtatactgctggaaactggactaatttctatctgactaataaaaatcccaaataaaaatggtacatttttattttaaatggaaaaagattagtttctgaatataaattgagtttttaagtttttctttttggttaattaaagtctactctgatgcttttttgttaattttctttaatatccatatctcctaaatttaatatgcagttctaaaataaagacaagtcagctgggtgtggtggttcatgcctgtaatcccagcactttgggaaactgagcctggcagatcgcttgagcccaggagtttaagaccagtttgggcaacatggtgagaccctgtctctacggattttatactttttttttttttgaaatgggatctcactgtattgcccaggctggttttgaactcctgggctcaaatactcctcctgcctggtactacaggcattcaccaccccacccagctgattttgtacttcttgacaggaaaagaaaaatgaacaagaaattccttaatgcatattttaagtgctgctttaaaattttatcagtacagctttagaacatcacgctagataatagtgttgtactgttatttcctttttaatttattaagaaaaaggaagatgcaggggaatgaatctttattgaactttcctggcctgttcaaggaatagtaaataaaccaacttagctggaggggagtggagagggccttgtaggccattgttaaaaccttaggcttttactcaggttgagatgagaagtcactggagagtgttgaacaaagaagtgacattatgtgacttaagctttaagagggttgctttgctctgttgagaatagattctacctgggcaagaaaggaagcaaagaatatttaggaggctttggtaatgatttgggcaagagagcatgatggcttaggctagagtgggagcaatgaagatatgataaatgtttatattctgtacatattatgaaagtagagataacaggattttccagtgtgatgtgtgagaaagaggggagttatatttttggcctaagccaaggtaatgatgggattcccactaactgagatgagggaagactatggggaggaaggtcagttcagttttggacatgttaagttcaaggtatctattagacagccaactggagatgttgagtaggctattggatatataattcttcagctcagagaagaagatacatatacatttgtgagtcattagcttattgaaggtatttacacccacaaagctaagtgaaatagaaaagagaagaggtccaagggcagtgggggtcacagcaatgttaaaacatcaaaatggtaagtaagactcagagaggagactgagaaatagtgtccagtgaattagaaagaaatctggagaatgtaatactccagaagccaagtgagaaaaataatttcagggaggaaagagtgttagattgtgtcaaatgatgatggatcagaagtatgaagagtgagacttgaccattggttttaacaacattagagacctcatcaagaacagatttaatgaaaaagtgccaaaacctgattagagtcaacttaccagagaatgaaaggagaagaactagaaacaaccaataaagacaactcttttgaagaattttacagagaaatgagatagtggccgggtgaaagtatgatcatgataaaggggtgtgtgtgtgtaatgaatgtgagatgtgagaaactgcagcatgtttataatctaattggaatgatttagtagagaaaaaatgatgatgagagagagaattgctgctgaaatatcttcaggtagggaagagggaatcgaatctactacatttatggaaaagtagctgtaggctggagcacagacagttcatctgttgtgacagaatgaaatgccaggtatatggatacagatattagaaggtaatatgatgatttgataaataaaaacaaggtctaggtagatactttccatttttgaaagaaatgtgttataaaaattattaccattttagcatagtggaaaggaatgaaattggagggagataaacctgggtttagattttagctctgccaattactagctgacatgtggcagaacttagttacaatgcccctgtattatttagggacccagcaagaaataaaattcactaaaaagtggttcaaataaaaacactttaatgaagagtctactttgagagaatgaacagagttaaggaatgggcaagatatggtaaggcaactagaaactagcaattatggaaagctgttacctcacctggggctgaagaggcaagagtggacatggtgtttttagtttagtgattgccaaaggtatgaaggaaggaccagctagtaagagctatagttgtggaggaacacagctgttgccagagacaatggtacataggtaaggaagcagcagagaagaaataaccttgatctctctctactcctcaactctatttttctgctattgacctccattggctaaatgtaagcagaaaccagctgcaaggcttcttaggtgttgcagaatatagggttcactctccctagggtccagagaagggcaaaagatggatgtggagacaaatgctgagtaatcagtagaatcactaagcctcaacttctccatatataaaatgaggctaccgcaaagttgctgtgatgttacatgtactgccaagcactgctacattgctagcatatagtactgtttattaaatgacaaatataagatgctacagcataatggttggtccttaaagctttggaattaggcagatctagatttaagttctgtccgtcacttactaatcatgagattttgggaagtctttgttttgtcatctgtaaaatggggaaataaggcttaccacagagaattctaataaagatgaaaagggacagtgtatattaagtgcctaatatagtgctggtacacagcatgcagtttaagttaccatgaccatcataatattatatgactagaaagaatagtaaatgacatcagtttccaagtaatactagtctcctacccctccccctccccccacactttttttttctgcttctcagtttttctgaatagggttatttctttgttacatagggttcaaggttaatatctttgcactttaaacaattaggaaatatagctttagttagtttaactttttggctattcatttattttgtttttgatttatgttcgctaaacacacacaaagagttaagtggatttttttattaggcctaagttggaaggcatagaaaaagttggaaacactgaattcagtcagtttcattagcatagatttatatatgaagctcaagtaaaatgtcatcaagaaatgggagaatataggatgctgtaacagttaattcagagccgtactataataagtattctttttaaatttcacataaatataacagttctgtaagcttgatttgagggcacatacatgtttttctttttggctacatagagaacaatgaaataaagcctcattgacgtaattgaacctgataacatctcctggttgtactgctgatgtttcactgtggttttggtggttttgtagagctccgtagagcgtgttagacttaaaaacatattcaaacagaaacttttatcaggattcaactttttaaccataaagaaaaaatgaatgtaaataaaggtgcagtcttgggtacacctagatcaacttaaaaatgtttaatagtatatattacttagagaaattactgttccttaattagttttgaacaaataaccacagtatgaaaagaaataataatttctggtattgtattatatattagcacagaaggaaagaggtaaatataataatggaagctcctaaaaacagcaagttaaaattttatgctttcattaaatgatgtcttatagtttgatagaactacatgtttaaaacataccatagcactataactttttgttttaaactgggattaaaaatttaattttatttattttatatatatatttataaaattcttatatttaagttatttacaagatctactttggtattgggtttagatgcctaaaactttgctgacttggaaacaatgtgtatcagagcatttactgtctacttggaagtaaaattttaaaagagctacattttattatataggaggaatgagtgcttgaaccagtatttcttaaaagttttaatatacatgtaccgccaactatgcattccgtatgcgtggtagctacccaccaacttaaggtaaatgtataaaaaagaattaatcacaatttttgaaaactaaaaaattaaaatattttatatcagtgtatatttacaatattaaaggtatctctgtttagctcaatgttgagtaaataggctgcttgttgtaggttcattgtatatcgtcatattcttttctcatctctatttctcttaacttggaaaaatccaaccaaaattataatttatgaggacagtcagcaggggttttttggctgttggttctgaatactcaggttaaacatggactccagaattaagagattgctcactgaagactctttcaaggctgagtcacttgctaagttgatggacattatcatacttgaaagtttaagaaatagaggcttttgcattttattgaaaaaagctctttttgctctttatattttatatttacttttaaatattttatttgctcagtttttccaaagcacactgaaaagatgtatactctgtatccaaaaattgagtgcatttacatttatgctatttctttaacattgaactcagcataatgtattttaaccaccagcctctttctgtgaaaacaaacaaacaaacaaaaaaaaaacagggtatatagatttgcagttagtgtagtactcattgcttagcaaggctttttcttgatgtgcagacaactgattttttctctcaggactgatttcatcacatatttcccagtctatatcatagtttacaaaacaaatattaagtaggaaaaaaaatcatgttttgtagtatgaatttttcagaggtaaacacaaaaacttgtctgctattcttcctcaagtgtattacacatataccaagagctgatttggctttgcacttcagtgcatttatcaagcagtaaagtaaaatatctggtttttctttcagcataatatttatcgtttgtgtggctgagagttttataaatctctcagcaatagtctatcttttttatatgcttttgctaggaggagcacagaatctgaatggtgcctgtgtagtttttgtctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattagagtcctattcttgatttaggttcaacatttattccgagctatttatgttaccctatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatactacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtcaaactgtagcaaaggaccaagcttttgggtttttccctgatctgttgtggattgatgcttttgtaaaatacactaaaaatgtctcaccattgtcaaattgctataaaaatatataaacctttactctgaatttctgtatttatcttattatggaccacactttgaatactgctctaagatgtgtacctagctgtggaattcctgggtcattcatcttctattacttatggagaaaattgttttctcaaaatcactaatgtgctacttgctcaaattacgcagaaggcagtctgctagctctttgtggctttctgtgtatctgctttcaattcctaatatgaaggggatttcacagtaagacctgctgctttagggtaacatagttttcatcctagagaaagtgactgcaaataagattgggctttgcttaagaattgattcaaagccaatctagcaagcacaagtgagagaaaactatgataatgggataaagggccaggaagagtgaatttattgagggagatggtctgtaatattgtaatactacaatattgtaatgtacaatattgagggagatggtctgcaatattgtaaaaatataatattgaaatattgtaatacaaaatgctacagtagagagatctaaagagagcaagcagagaaaaaagaagcattgtacatagtaagatttttagagacctttaagagtccagttaaaatagggcatacattccttctcatattagcagccttccttctgcataggcagcctttaattgtctaaatgcattagagaactttcacaaaatataagctaagatgagattgctcttataagcaagcagcaggactactttttatcagtgtttctccaccgtattttgattacaactccgaatccagggatatatatatatatatatttatattgtatatacatatgtaaaatatatgtacatatattaaatattatatatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcagactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaagaaaacatcagatttatagatgttatgataatgggaggaatggagaatagggtagttgacattctcaatctccaaagaagctgacaggctaaaataagggcagaagtaaagtattgcagttgggtctaaaaagccatatttataagaatagcatggaggaaaatggatcataacaatatcatgtataaaagaaacttagggattttaggttatgttaatcttaaggagcattttaggaagctattaacatcttaatttgcaataattagtgtctcttgaatctagattatatgctgattaaatcacaacctgaaataattatatcaggaccacatttaggaccatataaaatactgcttaaatttaatgagtctgttatatatatggtatactttgcatgcagttatatcagagccattttgtgggcactggttcacaagtcttctgagtgattgtactgtgtctgaattttctttgggaagaaatagatttttcctcagtggtaagaaagaaattacgttctgcaaggatattgatgaggagatggtgataatgataattgacagttttttgagtgattaaacatgggtgtattatgtaaaatatgagtcagcaaactgtagtccactgaccaaatgctgccagcagactgtttttgtatcacctttgagctaataattttttttgcattttaaagggttataaaacaaaaacaaaaagcaaagaatatgccatagagaccttatgtagccagcaaagcaccaaataagatcttttgcaaccagaaaacttaagcctgaaggacaaaaaacaacacaaatagttcaatatatagaaattatgagattatattacagattaactgggctcatattcaatacaggttcaaagctatgtacaaaatggctattagaatgaattatttaagcaaaagaagacctatttaactcagtaaatgtcaaagaaatttaggattgatgataggtagcagttatagcttcctaaattaaagttaattttatctccttgggcatagtgactactatattgggttgggaagcagccaaaaagcttgttaggaagaagggcaggaaaaaaactagtctgggactaaagttaccattgataagctaggctatcaaggagacagacaggaaaacaatcactaattatgtgcatatcaaaaggggtatgtgctgcttttgataagtctattcttttatacttaatctaaccccaaggacaacaagcttttcaaaatgtttttgacagaagtaccttattggtaggaaaatagcatcacccatcacccatgatgagcctttggagatggtgggtaggcagagaatatctgatgatatgtaatttttcttttattttttgtgacttaatgtgattatggatttatattttcctttttgtggtagtatttgaaggttaatatggcttgttttagttactttattgtgataattctttattcttttgatttctcaattatagattatattaatgaaatattctgtcgagataatttttattttcaccattccaatatctcttccagattttgagctatattagataattataattgaaaatgctgaattttgtctttacatatacttttttgtttatttttggtttgtaaccaagtgaatttttttttctagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacctggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgttcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttgaaacaaatggaaaaagaaagaaaatattagcaaaagaaatataaattataaagaagaaacaaatggaaagtatagagctgaaaaatacaataatagaaatttaaaattactggatgggatgaataacagtggagatgacagtaggatagaatctgtgagcttaagcatagatcaatagaatttagccaattttacaacatagaggaaacagaaacaaaatcagcaagccttagggacctattgggaagtaacaaagaaccaacatttgtattgctcgtgtttgagaaggagaaagggggtggcattgaaagagtatctgaagaagtaatggctgaaaacttcccagatttagccaaaaacttaatcctacagattcaagaagctttctgaaccccaaatagtatcaaccccctcaaaatctactctcagacatgtcataattaaacttatgaaagctaaagacaaagaaaatatcttaaaaagcatccagagagaaacaacacataacctataggggaacaccaattcaagtaatagcagatttctcatttaaaaccatgaagcccagaaggaagtggcagaacacttttgaagaggtggaagaaaatggctgtaaagtctatatccagcaaaagtattctttaagaatgaaggggaggaggttccaagatggctgaataggaacagctccagtctacagctcccagcatgagtgatgcagaagatgggtgatttctgcatttccaaatgaggtactgggttcatctctctggggcttgtcagacatggatgcaggacagtaggtgcaacccatggactgtgagccaaagcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgagctgaaggagaatgttcgaacccatcgcaaagaagccaaaaaccttgaaaaaagattagacgaatggctaactaaaataaacagtgtatagaagactttaaatgacctgttggagctgaacaccatggcatgagaactgcgtgacacatgcacaagcttcagtagccgattcgatcaagtagaagaaagggtgtcagtgattgaagatcagatgaatgaaatgaagcgagaagagaaatttagagaaaaaagaaagaaatgagcaaagcctccaagaaatatgggactatatgaaaagaccaaatctacgtctgatgggtgtacctgaaagtgacggggagaatggaaccaagttggaaaacactcttcaggatattatccaggagaacttccccaacctagcaaggaaggccaacattcaaattcaggaaatacagagaacaccacaaagatactcctcgagaagagcaactccaaaacacataattgtcagattcaccaaagttgaaataaaggaaaaaatgttaagggcagccagagagaaaggtcgggttacccacaaagggaagcccatcagactaacagcggatctctcggcagaaactctacaagccaggagagagtggggtccaatattcagtactcttcaacaaaagaattttcaacccagaatttcatatccatcccaactaagcttcataagtgaaggagaaataaaatcctttacagacaagcaaatgctgagagattttgtcaccaccaggcctgccttacaagagctcctgaaggaagcactaaacatggaaaggaacaactgctaccagccactgcaaaaacatgccaaattgtaaagaccatcgatgctaggaagaaactgcaccaagtaacaagcaaaataaccagctaacatcataatgacaggatcaaattcacacataacaatattaaccttaaatgtaaatggattaaatgctccaattaaaagacacagactggcaaattggatagagtaaagacccatcagtgtgctgtattcaggagacccatctcacgtgcagagacacgcataggctcaaaataaagggatggaggaagatctaccaagcaaatggaaaaaaaaaaaaaaagcaggggttgcaatcctagtctctgataaaacagactttaaaccaacaaagatcagaagagacaaggccattatataatggtaaagggatcaattcaacaagaagagctaactatcctaaatatatatgcacccaatataggagcacccagattcataaagcaagtccttagagacctacaaagagacttagactcccacacaataataatgggagactttaacaccccactgtcaacattagacagatcagtgagacagaaagttcacaaggatatccaagaagttaactcagctctgcaccaagcgaacctaatagacatctacagaacactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcagtcaaactggaactcaggattaagaaactcactaaaaaccactcaagtacatggaaactgaacaacctgctcctgagtgactaatgggtaaataacaaaatgaaggcagaaataaagatggtctgtgaaaccaacgagaacaaagacacaacataccagaatctctgggacacatttaaagtagtgtgtagagggaaatttatagcactaaatgcccacaagagaaagcaggaaagatctaaaattgacaccctaatatcacaattaaaagaacaagagaagcaagagcaaacacattcaaaagctagcagaaggcaagaaataactaagatcagagcagaactgaaggagatagagacacaaaaaacccttcaaaaaatcaatgaatccaggagctggttttctgagaagatcaacaaaattgatagactgctagcaagactaataaagaagaaaagagaagaatcaaatagacgtaatgaaaaatgataaaggggatatcaccaccaatcctacagagatacaaactaccatctgagaatactgtaaacacccctaagcaaataaactagaaaatctagaagaaatggataaattcctcgacacatacaccctcccaagactaaacaggaagaagttgaatttctgaatagactaataacaggctgtgaaattgaggcaataattaagagcctaccaaccaaaaaaagtccaggaccagacggagtcacagctgaattctaccagaggtacaaagaggagctggtactgttccttctgaaactattccaatcaatagaaaaagagggaatcctccctaactgattttatgaggccagcagcatcctgataccaaagcctgccagagacacaacaaaaaataattttagaccagtatccctgatgaacatcgatgcaaaaatcctgaataaaatactggcaaaccgaatccagcagcacatcaaaaagcttatccaccatgatcaagtgcgcttcatccctgggatgcaaggctggttcaacatacacaaatcaataaatgtaatccatgatataaagagaaccaaagacaaaaaccacatgattatctcaatagatgcagaaaaggcctttgacaaaattcagcagcccttcatgctaaaaactctcaataaattaggtattgatgggatgtatctcaaaataataagagctatgtatgacaaacccacagccaatatcatactgaatgggcaaaaactggaagcattccctttgaaaaacagcacaagacaggggtgcctctctctcaccactcctgttcaacatagtgttggaagttctggtcagggcagtcaggcaggagaaagaaataaaaggtattcagttaggaaaagaggaagtcaaattgtccctgtttgcagatgacatgattgtatatctagaaaaccccatcatgtcagccccaaatctccttaagctgataagcaacttcagcaaagtctcaggatacaaaagcaatgtgcagaaatcacaagcattcttatacaccattaacagacaaacagccaaatcatgagtgaactcccattcatgatggcttcaaagagaataaaatacctaggaatccaacttgtgagggatgtgaaggacctcttcaaggagaactacaaaccactgctcaacgaagtaaaagaggacacaaacaagtgacaatactgcccaaagtcatttatagattcaatgccatccccaacaagctagcattgactttcttcacagaattggaaaaaactacttgaaagttcatgtggaaccaaaaaagagcccacattgccaagacaatcctaagccaaaagaacaaagctggaggcatcatgctatctgacttcaaactatactgcaagcctacagtaaccaaaacagcatggtactggtaccaaaacagagatatagaccaatggaacagaacagagtcctcagaaatagtaccacacatccacaaccatccagtctttgacaaacctgataaaaacaagaaatagggaaaggattgcctatttaataaatggtattgagaaaactggctagccatatgtagaaagctttaactggatcccttacttacaccttatacaaaaattaattcaagatggattaaagacttaaacgttagacctaaaaccgtaaaaaccctagaagaaaacctaggcaataccattcaagacataggcatgggcaaggacttcatggctaaaacaccaaaagcaatggcaacaaaagccaaagttgacaaatgggatctaattaaactaaagagcttctgcacagcaaaagaaactaccatcagaatgaacaggcaacctacagaatgggagaaaattttcgcactctatccatctgacaaaagggctaatatccagaatctacaaggaacttaaacaaatttacaagaaaaaaatcaaacaaccccatcaaaaagtgagcaaaggatatgaacagacacttctcgaaagaagacatttatgcagccaacagacacttgaatgctcatcatcactggccatcagagaaatgcaaatcaaaaccacaatgagataccatctcacaccagttagaatggtgatcattaaaaagtcagggaacaacaggtgctggagaggatgtagagaaataggaacacttttacactgttggtgggactgtaaactagttcaaccattgtggaagacagtatggtgattgctgaaggatctggaactagaaataccatttgacccagccatcccattactgggtatatacccaaaggatgataaatcatgctgctataaagacacatgcacatgtatgtttattgcggcactattcacaatagcaaagacttggaaccaacccagatgtccatcagtgatagactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatgggtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtcagatcagccaccacattagattctcataggagcacaaatcctatggtgaactgcacatgcaagggatttggggttgtacgctccttatgagaatctaaggcctgatgatctgtggtgaacagtttcattctgaaaccatctcctcgcacccctacccagtctgtggaaaaattgtgttccacgaaacctgtccctgatgccaaaaaggttagggaacccctgctttaaacagaaaggaaattataaaagaaggactcttgaagtaacaggaaggaagaaagaacaatgaaacaggaagaaatagtgggagaatgcaatagactatccttcttgtgagtttcatgaatcatatttgatgattgcaacaaaaattataacatcatctgatactcaagacaagacaattatacttaaaagtaagcaaggtagagacctaactagtagtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaagtaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaacagcaattagaggtttttttgcctatcagatagggattaattaaattcatagttgctaattgtaatgggatatggaaaaataggtgctgttatatacaattagaagtgtagatttgatcaacatattctaaggcagttttagaggaatgaccttattttaacatgttaatttgcattcagcaattcagattatgggaagctgtgtataggaaatatgcttaattgttcacagtaacatatatagacaggtgtttattttagtggtatttgcaggggagaaaggctagaaatagttgggctatgccctggtatcaggaaatgttttaaagtgaaaactaatacatattaacacttcataagaaaaaaaattccgcaaagagcagacattatttagctagcttggtgtaatgttcataatatttctcagttccaaaatgtattggggatactttaataaacagttttgttgtgaactcattaatttgaataattattaattgcaaacatacccaaatgtaagttcaaggtacaacaacaacaacaaaaaacaaaagtaacatttaatttactgttctgattactagtccatttatttctatgggtaatcgagttgaacatcatatgtatgttttttcagagagtaaaaatcatctcatgtttacatcggtgacatatttcttctaaattaaaaaatttttttctaccaattttttaaggccttgcctgatgctaccctgtctgtgaggtttttgttaattattcatctttaagttatcgctatctcttttgaactataacatatttttctttatttttatctcatcattttccataatattaatagtaataatactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaagaaaaaaattaaagttcacggttatttgctacatatatatatatataaattttaagttagaattataccatttgttatatcatttatgccatgtacaaatgaatgaaaatttcactttttttctttctagaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaaggtcgaaatacagtaatcatctaaccctatttatcaaatttaatgatattttcaaattaactgctcctttaaattctatatagaatacaattttcgtttcaaggatcagacataatattgagctgcttgggatgttagaggcaattataagctcaaataattatagttgagtattcagtttttattttaaatacattgctgtgattagcacttataacaactatgtattattattcttgttaagaagtagagaacagcaagcaaattttgttccaggcttgtacaacaaactagtagtcagatcacgttattgctctattttattctttagaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttatttgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgtacaaaagaaaaagaatctagcttaaattatagagttcagacatattttttagtaggaggaagaggaatagaataacaaaatagagtgtgaaatttggagtaaattgacagattttcagaataaaatgtttcttttttctctgtacatgttaaaaatatactttgtattgatactttcatgtgccatcactaatattacatatatagcatattaaagagtgacattttaaaccattgttaaattattcaacagggactaaataggaatagtttgccaactccacagctgaggagaagctcaggaacttcaggattgctacctgttgaacagtcttcaaggtgggatcgtaataatggcaaaagacctcaccaagaatttggcatttcaaggtaaaatctgcagagccttttaagaaacttgaatcaaatgcatctactttgtttctgtcaataatgtttcaaatagttctggaagcagaaaggaatggttgaagtattttaggtataggacaacatgtgtagtaataatatggtaaaatagagaaactgattattaaagagaagctaatgtgtcttgtcctaaaactttgataggctgggtacaaaatgtgctggatccctgagaacatgagatagtttagggaaatcaggatcaactcaggactggatgctggggaagtttttaaatcgatagaagtggccattacagggttagccaccaatccaatgaatagtatccaaaggtaggtctgcagaattactgacttctgaaaagaggagcacgtttccaaggctcatcacaattgttaggtttaaggtaaccagactttcaaatcctgttcctgctggaggttgagacaactaatatattctatattctgttgaggatttacttggaactgaacaatgctaatcttataaatgaaaggcatcagtaactttaagtaaatgaggctgggaaaatgcaggagctgaaatctcccgaatgtaaatatatacatttaccctgataacaaaggatttaataatacagtactttgtcttttgaaagccaggaaggatactgatccttgtgtgagtttgtcataagttttttctttactcagctttctaattatgttaatataatattggaattggcacaaattctgtgttaaccattttctggtattactgagcatgttttatacttttgagctgtatagtttcacatttgaaacagtagatggcaggattggatcatagctatttgttaaagtttatgttaacagataattagatgattataattttctagattcttaggtggtttattaatttgaatcttgtataatatattcaagcaggtgaactccttttttgtaaaagaaaaattgaatgaagtgatgtctaaaacaggaatggattgaagtatgaagagtactgtacaggaaaatgagcattggtccaaaatttgccatggcctgaacatcatagtcttttttttttttttgtaaaggaagcaggatatagggaagtgaatgatgttaggaacagaaaatgtgacagtatttcttaactatgggtagcattatcttgagaatatagttgggttttaaaaggtatgataaaaatgttttatattttaacctttcatactgatgtaacagcaatgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttccccgcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattgcagttgtccctggttatccctgggggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatagtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtttcaaaataattaaaatacaaacaatgaaatatatataaggtatttggataaaaagtaataccctatttgtgtaaagaataatacaggatttaattttgcttttattcatgctttgcctagagaaaaaaattaagtattataaccctgggagctatgataaaaataatcagaagaaagaaaaccacagggaagaagagttagtcccccattgaacagcgaccctgttcttattgttaagagtttattattgttcatctgttagaggacttgagattttactaattaaggaggccattcctttacaacaccaaaatatgtttccaacatcaccttcctctagtcttctgaaattctagtcaagctgaactatttgatcttctctctgtccatctgtgcacccttttaatttaaaaagcaatttaactggaatagatctcaacttcagttctgtatatccttagttgggctcataaatcaccttataaggataacacctggaggtccttctcccttctccaaggagaagtactcttttcttcctctgaatttccataacacattctcttacggcgcttttcacatttgactttatgtcagccattactactcctctaaagcctgtttaagttctgtaaagagttcgagattgcattaaaatgaatctttgaagacaaatggctgcttaacaagtgtcctgcagaggtatggtatccatatgagattatgacccttaatcttgccttctgcttaagtttcagatctgggatgagatttctgtggtcagaaagttccaggaaaggttgttttctggatttgctgatgataaaattacccatctctgagttctagttttagtacaggttgaatatcccttatctgaaagtcttgggaccagaagtgtttcagatttcaggttttggaatatttgcctatgcataatgttgtatcttggggatacaacccaatattcatttatatttcatatacacatagcctgaacgtgattttatataatattttaaataattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcaattaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagtttatacaactgcattgaaactgagttggtacagaccttgttaaggtaatttgtattgactgtctagaagtcagctcttaaaatatagcttagctcagggaccataacttttgacgtctcttgttcgtttgcttttgacaactcattcccaagtgagtagaaaaagaaaaacaaactcaatttcttccaccatactctgacagcacatttctgataccagatgtgtggggatttctccccaccagcaagcaagcgagcaagcaagcaggcaagcaagcaattctgtagtagacataagctaggtgtcctataattcaattatttctttttcttttctttttttttttttttgagacagagtctcactctgttgcccaggctggagtgcagtggcacgatctctgcccactgcagtctctgcctcctgggatcaagcaattcttcctcaacctcctgagtagttgggactacaggcacatgccaccatgcccagctaatttttgtatttttagtagagacggggtttcaccatgttggccaggctggtctcgaactcctgacctcaggtgatctgcctgcctcggcctcccaaagtgctgggattacaggcatgagacaccatgcccagcctaattccattatttctgacaccatctacctggagatagcgtcagatcatactggttaaggactcagtccgacaagactgatctccacttctgatgccaatagcaagcctcaggttattttgcctgtgcttctgaccaaccagctgtaaatcagggttcccacagccccctccctgggttcaggtaatttgctagagcagctcacagaactcaaggaagcatgtttactggcttattacaaataatattttaaaggatacaaatcaacagccagatgaggagatacaaaggacaggtctggaaggggcctgagtacaggagcttctgcccctgtggagttggagtataccaccttccttgcttgtggacatgttcttgttcactttcctggaagcccccacgtgtttggctattcacaagctcctcagacccagtcctttctggatttttataggagcttcattttataggcatgattgagtaaatcattggccattggtgagcaatttaagctttagtccctctcctctctctggaggttgggtagtggggctgaaaacccccatcatctaatcctgtcttggtctttcaagtgactagcctctatcctgaagctacctagaagctgccagccatcagtcaactcattagcatacaaaaagacactttggagatcctcaggagtttaggagttgtatgctaggaaacagggactggactaaaaccaaatatgtatttcacaatatcacaccaagtctgactttaatcaccttcctgccaactattagtagtcattggaactactcgtctgcttgtcttctgctttcttcgtattgatttatgtaatttcattgaggtgtgtatttatctggtgctgggccaggacatgatgggaagattcgggaactaatctgagaacctatcatttgacctgtaactcttaattctaaatagctaaatgaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccagcttcatccatgtccctgcaaaggacatgaactcttccttttttatggctgcgtagtattccgtggtgtgtatgtgccacattttctttatccagtctatcattgatggacacttcggttggttccaagtcattgctattgtgaatagcaataaatatacatgtgcatgtgtttttataatagaatgcttcataatcctttgggtgtatacccagtaatgggattgctgagtcaaatggtatttcttgtcctagatccttgaagaatcgccacactgtcttccacaatggttgaactaatttacactcaccaacagtgtaaaagtattcttatttctccacatcctctgcagcatctgttgtttcccgactttttaatgatcgccattctaactggcatgagatggtatctcattgtggttttgatttgcatttctgtaaggaccagtgataatgatcatttttcatatgtttgttggctgcataaatgtcttcttttgagaagtgtctgttcatatcttttgcccactttttgatggggttgtatttttcttgtaaatttgtttaagttctttgtagattctggatattagccctttgtcagatggatagagtgtaaaaattttctcctattctgtaggttgcctgttcactctgatggatggtagtttcttttgctgtgcagaagctctttaattagatcgcattggtcaatgttgccttttgttgccattgcttttggtgttttagacatgaagtctttgcccatgcctgtgtcctgaatggtattgcctaggttttcttgtaagatttttgtggttttaggtcttacgtttaagtctttaatccatcttcagttaatttttgtataaggtgtaagaaaggggtccagtttcagttttctgcatatggctagccagttttcccaacaccatttattaaatagggaatcctttccccattgcttgttgtgtcaggtttgtcaaagatcagatggttgtagatgtgtggtgttatttctgaggcctctgttctatcctattggtctatatatcggtttggtaccagtaccagaggaaagaacaggcagtaatgattgctgttctgcagcctctcctggtgatacccaggcaggcaaacagggtgttttggttactgtagccttgcagtatagtttgaagtcaggtagcgtgatgcctccagctttgttctttttgcttaggattgtcttggctatgagggatcttttttggttccatatgaaatttaaagtagttttttctaattctgtgaagaaagtcaatggtagcttgatggggatagcactgaatctatatattactttgggcagtatggccatttttgtgatattgattcttcctatccattagcatggaatgttttttcatttgtttgtcctctcttatttccttgagcagtagtttgtagttctccttgaagaggtccttcacaacccttgtgagttggattcctaggtattttattctctttataacaagtgtgaatgggagttcactcatgatttggctctcttgtttgtctgtttttgttgtataggaatgcttgtgatttttgcatattgattttttatcctgacacttttctgaagttgcttatcagcttaaggagatttggggctgagacaatggggttttataaataattgaatcatgtcatctgcaaacagagacaatttgacttcctctcctcctaattgaataccgcttatttctttctcttgcccgattgccctgaccagaacttccactaccatgatgaataggagtggtgagggagggcatccttgtcttgtgctaattttcagaaggaatgcttccagtttttgcctattcagtatgatattgcttattggtttgtcataaatagctcttattattttgagatacattccattgatacctagttcattgagagtttttagcatgaaggggtgttgaattttgtcaaaggacttttgtgcatctattgagataatcatgcggtttttgtcattggttctgtttatgtgatggattacgtttattgatttgtgtatgttgaaccagccttgcatcgcagggatgaagcctacttgatcgtggtgggtaagctttttgatgtgctgctggattctgtttgccaatattttattgaggattttcatatcgatgttcaccagggatattggcctgaaattttctttttttgttgtgtctcttccaggttttggtatcaggatgatgtcggtgtcataaaatgatttagggaagatttcctttttttctattgagtggagtagtttcagaacgaatggtactagctcctctttgtacctgtcgtagaattcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcctggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgttctcattggtttcataaaacatctttatttctgccttcattttgttatgtacccagtagtcattcaggagcaggttgttcagtttccatgtagttgtgcggtttcgagtgagtttcctaatcctgagttctaatttgattgcactgtggtctgagagactgtttgttatgatttctgttcttttgcctttgctgaggagtgttttacttcccattacgtggtcaatcttagaataagtgcagtgaggtgctgagaagaatgtatattctgttgatttggggtggagagttctgtagatgtctcttaggtccacttggtccagagctgagttcaagtcctgaatatccttgttaattttctgtctcgttgatctgtctaatattgacagtagggtgttaaagtctcccactattattgtgtaggagtctaagtctctttgtaggtctctaagaacttgctttatgaatctcggtgctcttatattgggtacatatatatttaggatggttagctcttttgcatttatccgtttaccattatgtaatgcccttctttgtctcttttaatctttgttggtttaaagtctgttttatcagagattaggactgcaactcctgccttttttttttttttttttgctttccattttcttggtaaatattcctccatcactttattttgagcctgatgtgtctttacaggtgagatgggtctcctgaatacagcacactgatgggtcttgactatccaatttgtcagtctgtgtattttaattgaggcatttagcccatttacgtttaaggttaatatgtgtgaatttgatgctgtcattatgatgctagctggttgttttgccctttagttgatgcagtttcttagtagtgttgatggtctttacaatttggtatgtttttgcagtggctggtactggttgttcctttccatgtttagtgcttccttcaggagctcttgttaggcaggcctggtggtgacagaatctctcagcatttgcttgtctgtaaagtattttatttctccttcacttatgaagcttagtttggctggatatgaaattctgggttgaaaattctttttcttttggcggatcacgaggtcaggagttcgattccagcctgaccaacgtggtgaaaccccgtctctaataaacatacaaaagttagctgggcgtggtggtgcgcgcctgtaatcgcaactactcaggaggctgaggcaggagaattgcttgaacctgggaggcggaggtggcagtgagctgagattgcaccactgcattccagcctgggtgacagagagagactccatctcaaaaaagaatactggccctcattctattctggcttatagggtttctgccgagagagatccgctgttagtctgatgggcttccctttgtgagtaacctgagctttctctctgggtgcccttaacattttttccttcatttcaacttcggtgaatctgacagttatgtgtcttggggttgctcttctcaaggaatatcattgtggtattctctgtatttcctgaatttgaatgttggcctgtcttgttaggttggggatgttctcttggataatatcctgaagagtgttttccaacttggctccattccccctgtcactttcaggtacaccaatcaaacgcagatttggtattttcacatagtcccttatttcttggaggctttgttcatttctttttattcttttttctctaatcttcttgctttatttcatcaagttgatcttcaatctctgatatcctttcttccacttgatcaattaggctattgatacttgtgtatgcctcacgaagttctcgtgctgtgtttttcagctccatcaggtcatttattttcttctctacactgattattctagttagcaattcgtctgaccttttttcaaggttcttagcttccttgcattggattagaacatgctcctttagctcggattagtttgttgttacccaccttctgaagcctacttctgtcagttcatcaaactcattctctgtccagttttattcccctgctggtgaggagttgtgattatttggagaagaggcgttgtgttttttggaattttcagcctttttgtgctggtttctccccatctttgtggatttatctacctttggtctttgatgtttgtgaccttcagatggggtctttgagtggacatgctattcctttctgttgttagttttccttctaacagtcaggcccctttgcttccggtctgctgcagtttgctggaggtccactccagaccctgtttgcctggatgtcaccaggagaggctgcagagcagcaatcattactgcctgttctttcctctggaagctttgtcccagagggacacctgccagatgccagccagagctcttctgtatggggtgtctgtccgcccctactgggaggtgtcttccagtcaggatacatgggggtcagggacccacttgaggaggtagtctgacccttagcagagtttgaaaactgtgctgggaggtctgctactctcttcagagccattgggcagggatggttaagtctgctgaagctgcacccgtagccaccccttcccccaggtgctctgtcccagggagattggggttttatctgtaagtccctgactggggctgctgcctttttttcagagatgccctgcccagagtggagaaatctggcagtctggcctcaatggccttgctgagctgcagtggggtccacccagttcaaacttttgggctgctttgtttacactgtgagggcaaaacgcctactcaagcctcagcaatggcagatgcccctccttccaccaagcttgagcatcccaggtggatctcagacagctgctgtgctggcagtgagaatttcaagccagtggatcttagtttgctgggctctgtggcggtgagatctgcagagccagaccacttggctccctggctttagccctctttccgggggagtatagggttctgtcttgctggcgttccaggtgcccctgtggtatggaaaaaacaatacaacaacaaaaaaaactcttgcagctagtttggtgtctgcctaaatggccgcccagttttttgcttgaaacccagggccccggtggggtaggcaccggagggaatctcttggtctgtggattgcgaagactgggaaaagcgtagtatctgggctggaatgcactgttcctcacggcacagttcctcacagcttgccttggataggggagaaaattccccaacctcttgcccttcccaagtgaggtgatgccccaccctgcttcagctcgccgtctttgggctgcatccactgttcaaccagtcccagtgagacgaactgggtacctcagttggaaatgcagaaatcacccaccttctgcgtcaatcttgctgagagctgcagactggagctctttctattcaaccatcttgcctgggaacacacacatttttctatttgaatgttgccccgggtggtactgttactcttcttttccagtctttgccaccccacatgtaggcagttgccggtatgaaataatcaaaaggataagaatccagcttaaaagagtttattcaaacacaaagctgtggatgcccatccaggaaacacagactccaaggaaatagggtcagtgcttcaaagttgaaaagttaagatcatatttgtataggcagaaaacaaagatatttagcagaataacattttccacacaaagttggcttctgagttacagcaatttgattagttacagcttgtttgttttctttttccaatttaaaagaatatatttaacagtccatcttagaaagtgtgtctttgtgtaagagaagaaaaagggaagttaatctataatgaagatcaacagtaaagagggaaggagtcttctttgacatcctttagttatttgcagcatttagcaaagcagtgtaagttaggggggaataaaaggctaatctgtagtcagggaaatcaaggctatgtctgcctaggttacagctgcctgttagtgactgaggtcccaaaatcacattcctttaaggctcagaataaaagttccaaaatttggttttgaattacttattttcacacaatgaaaatatgaagaatgactgagcattgacagggagatgagttcattgggtggtattatttgcttactgcttgttttttgcctacactaataaaagttgtcaatacttgtgaggatagggaacagaaaaaaatgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttgtggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagcaaaggtcatcttctgtatcactgactcaccatgtaggtctcagaagagctggtaagaaatcattctttatgactcaaatatgggggttctcaaagtatatggtagtgtaaacacttttcatcacatatttatagctaattttgaatacaatttcatgtattataagttaacatgacttagcagtttgggttggctactaattgaccgtttgctaattctttcagtaaaaacagttttagaacatctactctgtaccaggtattttgctaagcagtagggattcagagataaaatatataactatttaactaacctgaatggttgcagacccaggacaagggaaaatcttcaagaaagagtatttttttttttcatagaatgataattgtggagaaaaaaattttaggattagaatagaaaaaaccatgacttcatcctggaaaaacattatgataggaattttttttaattaaaagattatagaatgattaaaaactcttggatgcaagatattttaataaatacaacataggaatagcaaagcaatactgatattgtgcttttaaagtacattatggctgatatcacataggtacaattttgtgattgggatatacaattacaaaattcttttatacacaataacctataaagcatgtgaagagatcagaaaatattattgataatcaagaaaagtaggcactagaaaaagatctatatatgatattgatgctgtattttacaatctttaaaataacaatgatgtttaaaaggaaatagaaggaataatggccaaaatgaatggatacttcgaatagagaactagaacacatagaaaagaaatggacagtctagaactgagaaatgcacttgattaaattaaaagcttattcaagggtttaagaatggattggatacaacagaatacaaaagtagtgaacttgaagacagagaaatagaaaatacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgtcaattgtacctcagtaaatctggaaaaaatcttttagtaaatcagatgagaagtagaaaaacgtacatttttttcaaacaaacaaaagctgaaataatttgtagctggcagacctgtgctactaagattcagtaaaggaagtttcttaggcagggggaaaattatccagattgaagcatggaactacaagaacaaaccaaaagcactggtaaggctaaatagatgggtgaggattaaaaagtgttgatgggtcaaaaagttggcaaaggatatgaatagacacttctcaaaagaagacatttatgcagccaacagacataggaaaaaatgctcattatccctggtcatcagagaaatgcaaatcaaaaccacaatgagataatatctcacgccagttagaatggcgatcactaaaaagtcaggaaacaacagatgctggagaggaggtggagaaataggaaggcttttacacagttggtgggactgtaaattagttcaaccagtgtggaagacagtgtggcgattcctcaaggatctagaacaagaaataccatttgacccagcaatcccattactgggtatatacccaaaggattgtaaatcatgtggctgggcgtggtggtgcacgcctgtaatcccagcactttgggaggccaaggcaggcggatcatgaggtcaggagatcgagaccatggtgaaaccccgtctctactaaaaatacaaaaaaaaaaaaaatcagctgggcgtggtggcaggcacctgtagttgcagctactcgggaggctgaggcaggagaatggcatgaacctggaaggcagagcttgctgtgagccgagatcgtgccactgcactccagcctgggtgacagagcaagactctgtctcaaaaaaaaaaaaatcatgctactataaagacacatgcacacgtatgtttattgtggcagtgttcacaatagcaaagacttggaaccaacccaaatgtccatcaataatagactgaataaagaaaatgtgaggccgggcgcggtggctcatgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctatttgggaggctgaggcaggagaatggcatgaacccgggaggcggagcttgcagtgagccgagatcccaccactgcactccagcctgggcgacagagtgagactccgtctcaaaaaaaaaaaaaaaaaaaaaagaaaaaaaagaaaatgtggcacatatacaccatggaatactatgcagccataaaaaaggatgagttcatgtcctttgcagggacgtggatgaagctggaaaccatcattagcaaaccatcacaagaacagaaaactaaacaccgcatgttctcactcataagtgggagttgaaaaatgagaacacatggacacagggaggggaacatcacacactgggaccaatctgaggctggggggctgggggagggatagcgttaagagaaatacctaatgtatatgacgagttgatgcatgcagcaaaccaccatggcacgtgtatacctatgtagcaaacctgcacattgtgcacatgtaccctagaacttaaagtataataataataaaaaaattgatgggtaaacacaataataactttcttttagcatttatgaaatacataaaagtcaaatatataacaatagcatagagggtagtcaaggggtaaatggaattaaatttgtcgtaaggtactagcaatgcttgaaaaacagtaaaaagttctaatttaagagaagctaatattcaaagatgaacattgtagtattcagggggccaattaaaagaccagtagaaaaagatataactaaaaagcttataaggaggtaaaatggcatgattaaaaaaagcttgaataattcaaaagaatctgagaaaagaaaagcaaaaacagaagaaacacacaaaaaataaatagcagcatggtggattaaacacactttattacattaaatatacacctttggggtagaggaagggatctgactagagttgtcagtatattatctgaaatgtcaagttttcaacaaaaattggactttacgctccaattaaaagacaaagattaggctgggcactgtgactcacacttgtaatcccagcactttgggaggctcaggtgggtggatcacctgaggtcaggagtttgagaccagcctggccaacatggtgaaaccccatctctacaaaattcaaaaatacaaaatacaaaaattaaccagacgtggtggtgggcgcctgtaatcccagctactcgggaggttgaggcacgagaatcgcttgaacccgggagacagagattgcggtgagccgagattgtgccactgcacttgagcctggacgacaaagcgagccttcgtctcaaaaaaaaaaaaaaaaaagtaatcttctgactgctcattggttgatgtccaaattatactgatccccccagggatgacttctaggaaaccatgcttaaaaatataatcaaaaacttaagagaaaaagctaacagaaaactgagtaactacacattgcaggagaaacagaaactacacaattagttcaggtaagtcactaaacaaattatcagaaagaagaaaacacaaagccagcaacataataaacctttggtgttggagggatctgatatcaaaactttacagtattttatgtaaaatgtacgattttcaagaaaaatatgtgaaacatgcaaagatacaagaaatttttgacatgtacccaaggaaaacgtaacccatagaaattatccctgaagtggattggattttagacttagtataaaacaaaactgtaacattgttttaataattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaacttactaccaggctacagtaatttagtatggtactggcatagagatatttctattcaatgaaattcaatttggcagtttctcaaattttaaacatgaagttaccatatgacccagaaattctacttcttgatatatatccaagagaagtgaaaccgtaggtccacacaaaaacttgtgcataaatgtgtatagcagcattattcataatagctaaaattagaaacaacctaaatggctatcaataaatggttaaacaaaacgtggcttaaccatacagtagaatattttttgtcacaaaagtgaaatggagtagtattcatatgccatgaatgaaccttgaaaacattatgctaagttaaataaggcagtcacaaaagactacaaattgtacaaatctactcatataaaatgtctaaaatggacagatctatagatagagaaagtatattagtggttgctatggttttaatgcttgtgtacttccaaaattcacatgttgaaacctaatccccaatgagacagtattaagagatggggccttttggagatgactaagcatgaggttggagcctttgtgaatgagattagtgctcttataaaagaggcctgaggaagctagctatcctgtcagccatgtgaggatacagtgaaaaaagtaccatctgtgaggcagaaactgagccctaatcagacatcaagactgctggcaccttggtcttggacttcccagcctccaaaaactgtgagcagccaagttctattgtttacaaattgcccagactaaagtattttttttttttaggtggtatagatggaattttaatacagtgaaagaaaatagggagtactgagttaatggttttgggtcatctttataattatctggtagaagactgaatttccatcttacatattatatacacagaaatctacagattggctacaatttaggtgttcaaaatgggaattaaaagtattataaaagcatataagattcagaaagtttaaatagataaatattttctaataataaaaccattaaaagttgataacatttttttttcttttatttattattatactttaagttttagggtacatgtgcccaatgtacaggttagttacatatgtatacatgtgccatgctggtgcgctgcacccactaactcgtcatctagcattaggcatatctcccaatgctatccctcccccctccccccaccccacaacagtccccagagtgtgatgttccccttcctgtgtccatgtgttctcattgttcaattcccacctacaagtgagaatatgcagtgtttggttttttgttcttgcgatagtttactgagaatgatgatttccaatttcatccatgtccctacaaaggacatgaactcatccttttttatggctgcatagtattccatagtgtatatgtgccacattttcttcatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctcggatggccagtgatgatgagcattttttcatgtgttttttggctgcataaatgtcttcttttgagaagtgtctgttcatgtcctttgcccacttgttgatggggttgtttgtttttttcttgtaaatttgtttgagttcatcatagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttgtggttttaggtctaacgtttaagtctttaatccatcttgaattgatttttgtataaggtgtaaggaagggatccagtttcagctttgtacatatggctagcgagttttcccagcaccatattaaatagggaatcctttccccattgcttgtttttctcaggtttgtcaaagatcagatagttgtagatatgcggcgtgatttctgagggctctgttttggtaccagtaccatgctgttttggttactgtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccctcacgtcccttgtaagttggattcctaggtattttattctctttgaagcaattgtgaatgggagttcactcatgatttggctctgtgtttgtctgttattggtgtataagaatgcttgtgatttttgtacattgattttgtatcctgagactttgctgaagttgcttatcagcttaaggagattttgggcttttttttatagcaagttgaatgaactaagacagtggtcccttgtgactatgggtaggagcgacaggaatagagaatgactgctaatgggtctatggtttctttttgagtttatggaaatattccagaattagatagtggtgatagttgcacaactctgtggatttctaaaattcagtgaattgtacaatttaaaatagtaaattgtatggtatatgaatgatatcttaaaaggctgtttaaaaaacacgtaagcatgttctgtcaccacagtggaattagatttgaaaacatctctcaatagatctgcagaaaatcctcaaattataaataacctatgggtcaaagaagaaaaagcaatgaaaatcagaaaatattttgagctgaataataatgaaaataggacttattaaaatgtcggaagaagctaaagcagtgctttcttgggaaatttatagcaaaaaaagagaaaaattaaaaatctgttaagcttacattttaagaagctataagtttcacagcaaagtaaaccaaaagaaagaagaaaacatgacactgatacaaaaagattacactgatacaaaaatgataaaaaatctgaagagtcatatatcttctaacgaaattaaacctgtagttaaaaaccttcttacaaataaaattgtaggtccagatgactttactggtaaattcttccctatatttaacgaaaatgttgttatgaaaggttatatccaatgccttagttttctatagctgcttgctgtaaactgcatattcatatctcctcacttacaccccaattcatgtgttgaaacctaatcctcagtgtgatggtatttggagctggggcctttggaatgtgattaggtcatgtgagtggactcttcatgaatgggatgagtgccttataaaagagacctcaaagagctctctaatcccttccgccatgtgaggacacgagaagatggccgtcagtgaaccaggaagtgggccatcatcagacaccacatctgccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccttcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatataggttctgtggtttaggatatggacatctttgggggtgattattctgcttaccacagccaatcttacacaactctttcactgaaaagggaaagaggaaacaccagttttttatgaggccagcataaccctaatattgaaacctgacaaggatattacaagtaaattagaggccaacatctcttgtgaatatagatacaaaaatcctaaacaaaaagttacacatataattgagtaatatattaaaatgataataccataatgttcatgttgggaagtattattacaggaatataaagtctgtttaacctttgaaaattcactgcattaatagaataaaagagaatactcatatggtcatcttaattggtacagagaaagcttttcatgtatgttcatttgataaatttgataattatgataaaaaattataagcaaattgggaatagaggggacatttttaatctgataaagtatctatcaaaaatgtttttcaaacataatacataatgaaatactgaacatttttctcctgactttggaaacaagataaagatgttcactgtaaatacttgtctccaacattatcctgtaatttctagacaatgaatgaagacaagataaagaaaaggaataaatattggaaaggaagatataaacccttttatttatttgcagattaccattttgtatacatggaaaatctagaaggctctaaaaatatagtaatagaattaataagtaaattttgcaatattttaattgtacagaaaaattaattatattactctatactatcagaaaatggttaaaatgaaatttaaaacaccatttaccacagcatcaaaagccaccaattacgtagagataaatttaataaaaaatatgcaatgctgctacactccataacttcagggaaaaatttccgtaacaagacataaaaatacttaccatatgggattagatgaataaatttgactacatgaacattaataacctctttattgaaaaaagtcatataaaggccaggcatggtggctcacgcctgtaatctcagcacttagggaggctgaggctggtggatcatttgaggtcaggagttcgaggccagcctcgtcaacatggtaagaccccatctctactaaaaacacaaaaaaattagctgggcgtggtggcgggcacctgtagtcccagctacttgggaaagctgaggcaggagaatggcatgaacccgggaggtggagcttgcagtgagctgagatctgagatcacgccactgtactccagcctgggcaactgagtgagactccatctcaaaaaaagaaaaaaaaaaaaagctaggtgtagtggcgggtgcctgtaatcccagctatttgggaggctgaggcaggagaattgcttgaacccaacagatggaggctgcagtgagcccagagtgcaccactgtactccggcctgggcgatagagtgagactccatcaaaaaaaaaagtcatataaaaagaattgaaaatagtaacaacatctgagaaggaactagaattcagctgtataaagaactttgtcagtggaagaattatggacaactattcattttctattgctgcatatcagattacaacaaatgtagcagcttttgtgcaagagtccacacacagctgagtcctctgcttgaggtgtcataagtctcaaaacaagatgttggctctaccttgttctcatctggagaatcagctgggaatgaatcggctgccaagctcattcaggttgtcctcaggttgttcttcatttccgttggttgtggattcttgatggctctgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttattttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttcccaactgtttattatttctgtttcaaaatgttgattacagttaagtcctcaacattttggataggttcttggaaactccagctttaagctaaatgaccatagtttttttcggtgttataatgaaatgacattattttaagatgtgctataagttgtttcacttaaaatgtcagttttcaaaaacttattgatgatattgaggactttactgtattttaataaagtattaccagttttctagttctatgttataactagatgatggattcagcctatattcttttccttatttatctagtagtttttattctaaataaatatcttctcattttagtggttattaattttttaaattaaatggtctccatctgagctaaaatataatggtattctacccatcctaagatcttagtaaatattaaagtattttagtatacactactttagtacctattcatagtacccagtaaatggtgtttgatcttatttctgctttactaatagtaagggtttacctcagatccaatgttgacttttcaaaaatattttgtttccttcaaggacacacagatactttctaggttaaagcctttgaactttatggagagattggaattttaggatgcgttgcagttgggatcttggttaaaaattaaacagattttctaattgtgttcaggtaaaaaacttgtacctcatttaccgtatatatttatctattttattctataagctgtggacatcaaatgctgaaatatgtttcaacatctgaatcagatggtacagattgctgcagtggaaaatcaggtgagattacaaaagtcatatgtatttgagtttaagagaaatttcttacaatgatttttagaatgggaaaatgaatgagtttaacttcagtttatccatctttaaaatgaagattattattttttacccacttcacagaggacttatttagaacaaattataagtaatagatggtgaaagtaattcaaagaataaaaatgtcccatacaaatgaatgtagtcttcttaggttatgtctattgtttataaatagtggaattatttatattaaacattgaaatttgtagtgcacaatctaaatccaaacggttttgcataaattttttatggcataaagaggggttgttttaaagtgtggttaattatatcattctgaaatattttgtatcctcatacaagacatattgtgttgatgaaattatagttgttttataaccttaaaatttgatgactcaaactaccagtagtagttaactaagtaactcagaccaacatttcccctgagggcagctagaaaaggtggatgaattatttttttaaaaaaaatctacttgaagccattgaagaactaaaaaaatcttatgaatcaccagtacaagatctgttggaagacagaactccaagaaagtgagcctggagtttggggctatcaaaagagtgtatgccaattccacagagaccaatgactgataggatgagcaattttattagcagcttcatggggctaggaagacagaggctagagttgaaggcttgccatggtttggataacttgataaactctaaagtgttgtatcctaagaaaaaagttaaaccaaaaatagataagccttttcagggattataggttcttctcaatccctttacataccataaaacttacccttttaaagtgtgcaatttaatagttttttgttttttacattttaaaggattgttaacaaataaaataaaataaaaagactaattcttcacaaactcttccaaaaaatagaagaggagggaacacttcccaactcattcttttttttttttttgtatatcattacaatggaattcagttcagcaattaaaggaataaacttctgatacatgctgcaacatagatgaacttcaaaacattattctaagtgaaagaagccaggcccaaaagatcatatattatatgattacatttatatgaaattcttgaaagacaaatttatagagacaataatcagaacagttgttgcataaagtgagaatagggattaactataaataggcatgaaggaacattttgggtgggggtgttgagaatgttctaaaattggattgtaatgattgttgataactgcaaatatactaaaattgttaaattgtacacttgtgggctggatgtttgtgttcctccaaaaattcatgtgtcgaaatcctataccctgatatgacggtattgggaggtaaggcctttgggaggtaattaggtcatgaaggtggatccttcatgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagtttttaaaaagaacaataatttattaagtgtcatatttctttgggtggactagcctcaactgggagattctcacctgaggactttgatgagattgcagtcagtgcagtcagatattggttggggaagcagttatctgaaggattgattgggcagaatttccaagatgggttactcatgtgccttttggctattgaccagtccatctaaatatgacccctccatgggcttcttcagtttgttggcagcattccaagagagtaggaagtggaaactaccagttcagttaatggctgaactcagaacagagtgtcacttctgccatattctgttatcagagcagtcatgaggcctgttgagattccagagggttggtaaataaatgctctgtcttgatagaggagtgacaagaatacatttcagaaaagtgtttgggacaagagatagtgttgtagacatctttagaaagaaatgcttcatttacctcacctgtttttattattatctgtaagataatagttattaggagttcatatcattaaaaagtaaattatgtaatatacctcaagtgcaaacaacttttagattaacttctattttagaatatcattgtagttattgccttaccttaccaagaatactcgaatagtctaaatttaatttcttagactaatttttttcatttggaaaaaataatattttctaaacagtaatacttccagatcatcatctaatcaattaatgattggtatattcattgtattaagttgagattatactgacatttattaatcacctattatgtataacatcttgtaagatgggtattattatccaaattttacaggggagaaagcttgccattattaagtacgaaaatcaggatttgaacctagttttctgaaactcaactccaatgattactcttaagaatttttttttttttttttgagacagagtcttactctgtcatccaggctagagagtacagtggcacaatcatggctcactgcagcttccaactcctgggctcaagcaatcttccctcctcagtcttctgagtagttgggactacagcaccatgcccggctaattaaaaaaatttttttttgtagagatgagaactcgctctgttgcccaggccagtcccaaacttttggcttcaagtgatcctcccgccttggcctcccaaagcactaggattataggtatgagctgttatgcctggccaagatctctttttacaaaaaaacaaacaaaactctacatattgagcttatagcatgtaattatcatataatcagcacccagatccagaaacaaaataagaggctggccaaaatggccaactagaagcagctaatgtgcactgctgtcatggagagaaatagaaggggtgagtacatacagcaccttcaactgaaacatacatgtacacatgttgggattcatcaagaaaacaacccacagagaatgtagaaaagcaaggcaggatgactgcccacctgggagtgacacggagccaggggagcctccctcgcccagggaagcatgagtaagtgggcaaccctggggacccatgcttctcccataggtctttgcaacccttgagtcaggagaccctcctcgtaaacccactgcaccagggcttgcagtctgatatgcagagctctgtggcatcttggcagagtagctgctcaggcacatgtggagccccaggagctatagatacttgggtttctaggcaaaagcagctgcaacttggcaaagtaggaggttagacccccatacagacccctaagaagtagctgaattcaggggtctgagcagcaatggtcttcaggtcccatgtccacagcaccttgcaggataagaccactagcttggaactccagccagccactggtagcagtgttgatggagctcccagagggaggggtaggctaccatctttgctgttttgcagccttagccattgttgccttcagtgtaaccaccctacaaaaatgcagccagcttgcttttttatgtgggtccctgacctctcttctcctcactgggcaggacctcccaaccaaggtaaccagccactcttgccactgtttttcagctggcagtggttccgagcctccctgagatagtgctcccgggggagggacaggccgccatctttgctgtttcacagccttagccattgttgccttctggctctaggaagtccaaggtgactaggtactggagccgtctctcaccgcagcacagtagctctatgggaaagcagctagactgctttttcacatgggtcccagatcttatttcttttcactgggcagaatcctgtgaccaaggtctacaaccacccctgctagtgttttctgtccagcaacagtttcaaactttgctgggatggagttcccagagggaggggcaagctgccatctttgctgttttgcagccttaaccattgttgcctttgggatttggagagtccaaagtgactgggggctgcagcagaccccaaacacagcccaactgttatataaagaagtggccagactgcttttttacacaggtcctcaaccctatttctcctcactgggtgggacctcccaactagggtgtccagccatctctgctggtgttttctgaccagcagcagtttcaaacctccctgggatggagctcccagagggatagggggactgccatctttgctgttttacacccttcactgttgataccttcaggtgctagataaaccaaggtgactagggactggagtgtacccccagcatactgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcggactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacccagttcaacaaaactaagaatcacaataaaatgatacaggagctgacagatgaaatagccagtatgaaaaggaacctaactgatctgatagagctgaaaaacacactacaagaattttgtaatgcaattccaagtacagcaaaagagaccaagctgaggaaagaatcttgaaacttgaagactgactctctgaaataagaaagtaagacaaaaattattttaaaaagaatgaaaaggaatgagcaaaacctctagaaatatgggattgtgtaaagaggccaaatctacacatcattgacatccctgacaggagaaagcaaacaacctggaaaacatatttcaggatatcatccatgaaaacttccccagccttgctagagaggccaacacccaaactcaggaaatacagagaactcgtgcaagattctactcaagaagatcatccccaagatgcataatcatcagattttccaagtttgaaatcaaggaaagaatgttaaaggcagctagaaagggcaggtcacctacgaagggaacctgatcaggctaacagtggacatctcagcagaaaccctacaagccagaagagcctgggctcctatattcaacattcttaaaaaaaaaaaaaatcttcaagaatttcatatccagccaaactaagcttcctcagtgaaggagaaataagatccttttcagataagcaaatgctgaggaagtttgttactaccatttgttactacgagacccacttaaaagagatcttgaaaagagcactaaatatgaaaggaagaaccattaccaggcaatacaaaaaaacacagttaagtacacagacccagtgatgtaaagctaccacacaagctggcttaataaccaggtaacagcacaatgacaggaacaaatccacacacatctatactaaccttgagtgtaaatgggctaaatgccccatttaaaaggcatagagtggcaaactggattttaaaaaaagtaagacccaatgatacactgtcttcaagagacccatttcacaggcagcaacacccataggctcaaaacaaagggatggaggaaaatctaccaagcaagtggaaatcaggaaaaagcagaggttgcaatcctaatttcagacaaaacagactttaaaccaacaaagatcaaaaaaggcaaagaagggcattacataatggtaaagggttcaattcaataagacctaactattctaaatatgtattcacccaacacaggagtacccagatttataaagcaagttcttagagatctacaaagtgccttagactcccacacaataatagtgagagacttcaacactccactgacagtattaggtcactgaggcagaaaattaacaaagatattcaggacctgaactcaatatgggaccaaatggatctgatagacctctacagaactctccactcaaaaacaacagaatgtacatttttctcattgccacatggtacatattctaaaatccatcagacaaccctcagcaaatgtaaaagaactgaagtcatgccaaacatactcctggaccacagtgcaataaagatagaaatcaagactaaaaaaaatcactcaaaaccatgcaattacatggaaagtaaacaactggctcctgaatgacttttgggcaaatagtgaaattaaggcagaaatcaagaagttttttaatacgaatgagaacaaagatacaacctacaaaatctctgggacacagccaaggcagtgttaagagggaaatttatagcactaagcagccatatcaaaaatttagagagatcccaaattaacaacctaatatcaccactaaaataactagagaagagagagcaaaccaacccaaaagctgacagaaaacaagaaatagccaaaatcagagctgaactgaaggtgattgagacacaaaaacaccatccaaaagatgaatgaaaccaggagttgattttttgaaaaaattagtaagataaataggctgctagctagagaaatacagaagaaaagagagaagatccaaataaacacaattagaaatgacaaagggggtggtaccactgaccccacagaaatacaaccatcagagactactatgaacacctctttacacacaaactagaaaacctagaagagatggataaattcctgtacacataacccctcccaagactgaaccaggaagacatggattccctgaatagaccaataagaagctccaaaacggaatctgtaataaatagcccaccaaccaaaataaataaataaaaataaagcccaggaccagatggattcacagccacatcctaccagatgtacaaagaagagctggtactatttatactgaaagtagtattacaaaaaactgaagaggaaggactgaaagtattacaaaaaaatgaggaggaaggactcctcccccaacccatactatgaggccagcatcattctgataccaaaacgtagcagagacacaagaaaaaaacaaaacctcaagccaatatccttgatgaaaattgatgcaaaaatcctcaacaaaatacttgcaaaccaaattcagcagcacatctaaaaggcaatccaccatgatcaaataggcttcatccctaggttgcaagtttggttcaacatatgcaaatcagtcaacctgattcatcacataaacagaactaaagacaaaagccacatgattatctcaatagatgcagaaaaaggcttttgataaaattcaacatcccttcatgttaaaaactcaataaactaggtattgaaggaacatacctcaaaataataagaaccatctaggagaaacccacagccaacatcacactgaatgggcaaaagctggaagcattccccttgaaaacgggcacaagacaaggatgccctctctcaccactcctatttaacatagtattggaagtcttgaccacagtaatcaggaaagagaaagaaataaagggcatccaaataggaagagaggaggtcaaactatccctgtttgcagacatgattctatatctagaaaaccccgaagtctcggcccgaaagctccttaagctaataagtaacttcagcagagtttcaggatacaaaatcaatgaacagaaataactagcattcctatacactaacacagccaaaacaagagccaaaccaggaacacaatcccatttacaattgccacaaaaagaataaaatacctaggaatatagctaatcagggaggttaaagacctctacaatgagaattacaaaacactgctcaaagaaagcagagatgacacaaacaaatggaaaaacattctgtgctcatggataggaagaatcaatatcattaaaatggtcatactgcccaaggcaatttatagattcagtgttattcctaacaaactaccaatgaaattcatcacaaaactagaaaaagctattttaaaattcatatggaaccaaaaaagagcctgagtagccaaggcaatcctaagcaaaaagaacaaagctggaggcatcatattacctgatttcaaagtatactgcagaactgcagtaacaaaatatcatggtactggtacaaaaacagacacatagaccaatgggacagaatagagagcccagaaataagaccacatgcctacaaccatttgatctttgacaaagccaacaaaaacaagcccattaatggggaaaggactccctattcaataaatggtggtgggataactggctagccatatgtagaagattaaaactggatcccttccttacaccatatacaaaaatcaactaaagatggtttaaagacttaaatgtaaaacccaaaactataaaaactctggaagacaactgagtcaataccattctggatatagatactggcaaagatttcatgacaaagatgccaaaagcaatcataacaaaagcaaaacttgacaaatgggatgtaattatactaaagagcttctgcacagcaaaataaactatcagcagagtaaacagacaacctatggaaagggagaaaatttttgcaaactatgcatctgataaaggcctaatatccagcacctacaaggaacttaaattgacaagaaaaaacaaacataaaaaagtgggcaaaggatatgaacagacaatttgcaaaagaagacatacatatgggcaacaatcatatgaaaaacagctcagcatcactgatcattagcgaaatgcaagtcaaaaccacaatgaaacaccatctaacaccagtcagaatggctgctgttaaaaaggcaaaaaataacagatgctggcgatgttggggagaaaaagaaacacttatacactgttggtgggagtgtaaattagttcggtcattgtggtagacagtgtggtgattcctcaaagacctaaaaatagaaataccatctgacccagcaatcccattactgggtatatatccaaaggaatataagtcattctcttataaagccacatgcgtgtgtatgtttattgcagcactatttacaatagcaaagacatagaatcaacctaaatatccaccaatgatagattggataaagaaaatatggtacatatacaccatggaatactatgcagccataaaaagaatgagattgtgtcctttgcagggacatggatggaactggagaccattatccttagccacaggaacagaaaaccaaatattgttatgttctcacttataagtgggagctaactgatgagaacacatgggcacatagaggggaacaacacacactggggcctgtcagagggtggagggtgggcggagggagaggatcagaaaaacaactaatgggtactaggcttaatacctgagtaatgaaataacctgtacaacaaacccctttgttacatgcttacctatgtaacaaacctgcacttgtaccactaaacttaaaaaataaataaatgaaaaaaaatcacagctagtgaagtagtgaggctaggactcatttctataagtagtatttagatttgaatccagattctattttactatatagtttgggctctatcttatatgtccatagtggaaaagtaataaatgattatcatagtttttctaagagaaaaggcaaagaaaagaagatgtagtatatatacatcatggaatactatgcagctataaaaaagactgaggtaatgttttttgcagagacatggatggagctggagtcaaactaacataggaacagaaaaccaaatactgtcacttataagtgggagatgaatgacgagaacacatggacataaagaggagaacaacagatactggggcctacctgatggtggagggtgggagaaggaagaaaatcagaaaaaaatagtaattgggtactaggcctagtacctgggtgatgaaataatctgtacaacaaactccatgacacaaatttacctatatgacaaacctgcacatgtacccctgaacctaagataaaagttgttttttaaaaaagaaacaaaatattacccacacctcaaaattacccatcatgaccccttccaatcatatgccccaaagataatgatctttttgtctttcatacgcttttgaacttttcttaaagagaatcagagagtatatacttttatgcctggcttccttcactaaacattatatttttaagtaccatccatattgtagttcattctctttgctctgtagtgatcaattgtgtaaatataccacaagttatttattctactgtcgataggttttgggtaatttccctgtttaagatattacaaatagaatgaatatgaatgttttttaacacgtgaatgaatgctatttagctatgaatactgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatatagtagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttaaggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttagggataaaaatgtgataaacttagtattgttttgaattttgtttttaatacccaggactagattagaatagaattcacatgaccttcagtaaattaggaataaaaagctaaggagaagaatggaaaaattaaaaattgggacatgatatgtatggtaagccttctttaattttcagtggctttagggtgacatcttccattctgatttttttgaaagaattaattgtaggcaagttttaaataaattattaaagacgtatattaatacatggttaacattccagaatacaaatcacaaaaacattatactcagctacaaatagaaattctgatttttaaagtaaactttattttaattgacatttaggttatgtataccttatttcaagacactggtttattggaaatatttaaaattcccactcaacaatttatgaactattttcgtgcattagaaaatggctatcgagacattccttgtaagtattaacatattttattatttaagttcaaataatatgggttttgaaactctttatcatctttctcttcagatggtcccttaaacacttttaaaactgcttgtttgaaattttcttttttttttttcttgagacaagagtcttgatcttgtcgtccaggctggagtgcaatggcgcgatcttggcccactgcaacctccgccccccacgttcaagtgattctcctgtcttggccctcgcaggtagctgggattacaggtgcccgccaccacacccagctaattttttatatttttagtagagatggggtttcaccatgttggccaggctggtgctgaactcctgacctctggtgatccacctgccttggcctcccaaagtgctgcgattatagacgtcagctgccgcgcctggcctgaaaaatttttaaatggagttttaaaaagaatatttgtattatactacctagatttaactgactactgttaacattttgtctgttttttgttaacattttggtatatattctccaagagttcttacataaatttattttttgtaaaggtggtcataatattgatacatatttatgatctgctttttcacctggttgttatacagtatacatctttctatttttaaaattaattgcctgtgtactttatctttttaaaagttagtcaagagtttcagaaaatcattcacttaaaaatgcttaaaattgatcatctaatttcagtttttaactgtgttctgatttatggaataatttaatggctattatatattatgtttgaatataatttgagtttcatattagaaaaagatggactgtctttatatattgtctacagtttccctccatgtggacacatttttgagaaattaattctataaatagtgaattattcttcaattggcataactcactaataatgtttaataatttaagatgagttacatatactataatttccacttatatattgtgcattcaaaaaagtggttggattttataaatggaatatagggatactttaagatggacttcaagggaaatggaacgaaaagaaagaggtggtaaggagtcttcactgtcagcttcagttaggatacattagttaagaaaatagtctctggacctaacttttctaaactttaaaaatttgtgaatgagaataacaatagtacctactccataggtagtactaatataagataattaatgtaaagcacgtatcagaattcatgacacttagtaaattgttagtaaaaggtggtgatttattaataataattaagttcccagtgtacgccatgtcatatctataggcaaaacaatattattttatctactaatgcatacatacacattaaatatttgttgaagtgttaaatttttattggatatcgacattaactgcaatcattagattcacataggttatcttattcaatcttttttggcaaagttgtattatctaacttttataggtgagaagtaaactcagaaggatctttcccaagattataaaactagataccaaagtagtgtttcagttttaggtctatctgagttctgaagcctatactctttacactatgccacattgccttttcacatagttgaatttcaggaaatagatgttttattgatcatatatgatgtgtcagacactgtgctggatgctttcacatatttagtatttaattcctgtggcaagcctgagacatagtatttctgacctttttgtgggggacacaaatgtaagtaaccagaatttgtaactgttctgtgtacaaaactgttttgtgtgcaaacatgggtctctgtaatccagacactacatgatatttttgaaagccagaaaatagccaccttgagaacattttccaatgcctttcaatactccttggttatcctgccttttctttggcacctttactatgttttcatagtatatgggaaagtttttaaaagatattttttttaatacatcaagagactttagatgaaataaaattcaattgtggggaattagtctgtcacatcttttttatgaggatatagtatgactaggaaattattgtactttttaaatgttgtgtgttaaacctaacagaaaaacgttttggtgactttagatcacaatcgtatacatgccacagatgtgctacatgcagtttggtatctgacaacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaaattttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagctactcagaaggctgaggtgggaggatctcttgagcccaggagttcaaggctgcagtgagccatgattatgtcattgcactgacatatatcaagacagaatttgctcagttaccaatacttgagaaataacattaccatactaaccagtgtaaatgtcatagactcaaccactgatattactttttacattttggtagttgagtctaaagtatgcattatttgtttaatggatttgctttatgtcactggttcatttttgtctgccatctgtatttattctttctagtgcccttcattccttccaccagtcctgtgcttttattagagataattttcttcaacttttttgttttagctgtcattttgtcttagaagaatatatttatattttagcatgtttgaaggtattattccataatcttgtgactttcacagtttttgctgacaagtcaagacttaggtcatattgagaaatataatatataaatataatatgttcctttttctctttcctattggtttttagcattttaactatgatgtactcatgtaatttttttttgtattaatcctgcctgatgtttagtgaaccttttgaatatgttgattggtagttttttactggtttctatcatgctcttcaaaattcagcctctccattgtctaattccaaagccgctcccacatttttaggtgtttgtcacatcagtacctcacttctaggtgccaaaagtctgtattagtttcctattgctgctgtaataagttaccagaaatttagtcactgaaaaccacacaaatttattatcttacagttctggaggtcagaagtccaaaaaaggcttcactggagtaaaatcaaggcatcaacagaactatttttctcctatatactctagaggagaatttgtttccttgcctcctccaattacactccttggctcatggccctttctttctttctttctttgtttattttggagacggtgtctcactcagtcacccaggccagagtacagtggcttgatctcggctcaccgcaacctccgcctcctaggcgggttcaagcaattctcctgcctcagtctcccaagcagctgggactacagatgcacgctgccatgcctggctaatttttcgtattttagtagagatggggtttcaccatgttgcccaggctggtctggaactcctgagctcaggcaatccgcccacctcagcctctcaaagtgttaggattacaggcgtgagccactgtgtctggccggcccattctttaaagacagcagcataacatcttcaaatttctttttgaccctgaccttttgatctttccaaggaactagtgaaaatcaatccagctctgcaaccttggctttctgtgcagaacacacttaactgacagtgactctcttaattttagtctctcttgtagtctggataggctgagaatttcctgaattatcaagtccttattcctctttgcttacgagttctcccccaatctttctttttcctctcatatttactataaacagtaagaaaccagactacaccttcaatgctttgcttggaaatttcctcaactaaatgtctaagttatcatttgtaagttttgtattccacataactgcaacacctaattcagccaaattttctgttactgtgtaacacggattcccttgcctctagtttccaataacatgtttctcatttccttctgagcattcattggcaatgaccttaatgaccatttttctatctccagtctgttctcaatgacttaggtatagtattctctaagacaatatatgttttctctctcatgctgcacacttccttctgagttcttactagcagtgttatgagttctcatacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgcccaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctgaaaataaaacccaatgtctgatcctgaagttgcttgaaatacaatgcaaatgagtttgtggcctcagtagacttcttatgttagaattaagatatcaaatgggaaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatattggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcctcctttatcacagtggtgagaaatatatttcagcattaattcctggagagtgaaatgctatgctggtcctacagccagagttaggggcctatggaatttaggtgataaaaggattttggcctgggttcatctcataatggtagttagcagaaccacacccattttctgaatgtatagtttgagtaaacatattcagcaactgtcagaatcccttcatcaattccttgatctttggaaagaggaccatcgttgtaggaaggatcaaatggaatctccaggaattgcctcattctggcaaaacagtgaaccaaaagcagtataccacattcctagatgagttgcagaaatcagtgctactagcaaatacttaatagatgcaggaatggtgatttccatcacattgctgttcaacttaattatatagcttttacacaggataagtagatcctggaaaatgatggtggattattctcaatgtaatcaggtggttactctagttgctacagctgttccagatgtggtctcttcttttaataagttaacctaacttgtgatatttggcacagagcaattgatctggagagttgtttttcctccataactcatagcaaaattcacaagaagacatatatttacatctggcaggcatcacaatacacttctattgtcttagttctgggctatgtcaagtctttcattctctgttataatctagtctgttcccgtaagttatcaaggtcagccattacattgatgagataatgatgaatagctccattgagcaagaagtaacagatatcctagatgccttcataagagtgccagaagatgagagatgagaaaaattgctaaaaaattcagagatctgtcatatcattgaagtatactagggatccagtggtctaggacatgttgagatatttcctccgagttgagggataactgatacatttgaaattctctacataaagggctctttggattctgaaggcaaattcatgacttctgagtactattgctccaaaatactactgtaaggctgtatgtgcaacccagagcaagagaagcatgtgaagcaatttctactcgttgtgcaaattactctgccatttttccatctgactgccaaaagaaaatgtcttttgcagatagagatcccctttggagtctctagaagaccactacaagataattacagtgtaaatacatggagttttgaaacaaaaccaggcagctttcctcaaataattattttcctttctgtaaaagcagctaaattgttgttgcactttggtagaatctgaatacttggccatgggcactagattaccatgttacctgcccataatgaatttggggccctctgatcctccagttcataaatttgtcatgtgcagtagttctcaatcatcaaggggaagaattacttacaagattagttttgagttgctcctaaaagcacagaatgtaagttcagacttccatgacatttattcctaatacaccaatacctcttccttaatccatagttacggctttgtggggaattccctatgaccagttgacttaaagagaaagaccagttgccctggtttataaatagttctgcccaatatgccagtacttcctcaaagtggatagctacagcattgtaggatcactcaaaggtatcttttgaaaggtaataaggtaaatccttccagtgagcaggtcaagcggtgaatcagttggtcaagaaagagacatggccagctgaaaggatctgtactgatttatgatcagtagctaagagcttccttggatgctttgggacttagaaggaaaaatattttaaaattggagtttttaattggacaaggtgttttagttagggggtttatggctaaccttcccagagtggaaggtggatatttgtttgcgatgtgaatgcttactatgatgcttaattttacatgtcagcttggctgggcagtagtacctacatatttggtcagacattaattttaatatttccttcagggtattttttggatgagattaacatttaaattgatggactttaagtaaagcagataaccctccataaggtcggtgggcctcatccagtcagttgaaggccttaatagaaacaaagagtgacctcctctgagcaaacaggaattccaccagtagacagccttcagacttgaactggaatatcagctcttccttgggtctttagccaatcagcccaccctgcagattttggatttgccagcctccttaatttcatgagcaagttccttaaaataaatctctctctctctccctctctctctctctctatatatatatataaaatatatatatgaattatatatattcatatatatatatgaataaccctcactaatatataatatttgccaaaggccattcactgcaaagaaggctcttgatgatcaggtggacaaaatgatctcttatcttatagcgatcagtctctttccctatgaactccagttcttattccgtgggtttatgcacacaacagctaagtgtattagtctgttctgacattgctataaggaaatacctgagactgagtaatttgtgaaggaaagaggcttaattgagtcacaattctgcggctgtacaggaggcatggctggagaggcctcaggaaacttacaatcatggctaaaggtgaagggaaagaaaacaccatgtttctcaggctggtctagaactcctgagctcaagtgatccacctgcctcggcctcccaaagtggtgggattataggcatgagccaccgtgcctggcccatgctgttttgattactatcgctttgtaatagattttgaaatcaggtagtctgatgcctccagctttgttctttttgctcaagattgctttggctacttggaatgtttttgtggtgccatatgaatttttttttctatttctctaaaaatgtcattttttttgttgctaagtatgtagaaatgcaattgatttttgcatgtttatcttgttccctgctaacttgatgaactaatttattagttctaatagtttttcagtagatttcttgggatttcctacatatacgagattaggccatctgtgaataaagatagttttgcatcttcatttccaatctggatgtcttttactgaggcgtccttttaaatgtgtcagcaaatttttaaaatcacagttttctgaaacgaagtgaataaatgggattctaagtagttatgtttcattgcccttgccaactgtgttcttttttgtactgttatttttttggaaacatatataagctaatgttttaagatcctaatatataaattccaagtaattactgaatttaaaaggaaatattttgccatgtttgatttttaaaatatattttaaaattgtagggaaagtccagaatgtgtatcacataggaaaattcaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattagagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttctaggttcccccaatgaatacaaccaaggaaactttgtacctaatatctgtggttttatgtgtctactttaaatatagtttctttttccttcttatactttttaaaggtttcttttgcaaaaataatagaatgatcatctagatagataaagccaccaaaaaagaagaaatcaatggtaagatattaagacaccagaagcacagtgtggatagtgaacatattgtttctaagaagaggataaaaatagagttatgttgactgagatgttccccagttttccatgccttttcattttccactattttttattccgttatattatatggagcttcatgaaagaaaacaaaagggagataaggagttgtagttagggctacaaatgaaatgtaatctttccggatgagatttgaaaagcatctatgtagagaagcttagtttggtaagatattaaattcctaaatctttgtaatgttttcatcaaattttattctctagtattgcctttttctgttatatcatatatcctggccattgtatctatctagtcattaaacagcaaatatttagaaaatcagaggtttttaaaattattatttgcctgagtaagcatcaaacttgtgtgagaatcctatcacgtcttgtaaagtaagcaacttcagggtcagatttaacactgttcctctctactaacatgttaaattgggaataatatactcttttaagttcatagattttagttcttacttaaatcagcaaataaaataagtaagcatattacctatgagaatcccctccatagcaaaattgtgaggaatttatgtgctaatgctggtttattttgctatttattgtttctcagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggtaggaaatatttttaagaacctttaaagagtaattctgaaattttcagtcatgctgtgtatccctttataaatcattcagttgaatcatatgtccaatccatctgactttaataccctacattttaattaattggataacacatggcattaatgtgatgtgtgctaggaaattaggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagcgcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcccaggcttgcttaggtaaacaaagcagctgggaagctcgaactgggtggagccaaccacagcccaaggaggcctgcctgcctctgtaggctccacctctgggggcagggcacagacaaacaaaaagacagcagtaacctctgcagacttaaatgtccccgtctgacagctttgaagagagcagtggttctcccagcacgcagctggagatctgagaacgggcagactgcctcctcaagtgggtccctgacccctgacccccgagcagcctaactgggaggcaccccctagtaggggcagactgacacctcacacggctgggtactcctccgagacaaaacttccagaggaacgatcagacagcagcgttcacggttcacgaaaatctgctgttctgcagccaccgctgctggtacccaggcaaacagggtctggagtgcacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagaacgcctctcctcctccaaaggaactcagctcctcaccagcaatggaacaaagctggacggagaatgactttgacgagttgagagaagaaggcttcagacgatcaaattactctgagctacaggaggaaattcaaaccaaaggcaaagaagttgaaaactttgaaaaaaatttagaagaatgtataactagaataaccaatacagagaagtgcttaaaggagctgatggagctgaaagccaaggctcgaaaactacgtgaagaatgcagaagcctcaggagccgatgtgatcaaccggaagaaagggtttcggtgatggaagatgaaacgaatgaaatgaagcaagaagggaagtttagagaacaaagaataaaaagaaacaaacaaagcctccaagaaatatgggactatgtgaaaagaccaaatctatgtctgactggtatacctgaaagtgagggggagaatggaaccaagatggaaaacactctgtaggatattatccaggagaacttccccaatctagcaaggcaggccaacattcagattcaggaaatacagagaacgccacaaagatactcctcgagaagagcaactccaagactcataactgtcagattcaccaaagttgaaatgaaggaaaaaaatgttaagggcagccagagagaaagattgggttaccacaaagggaagcccatcagactaacagcggatctctcagcagaaactctacaagccagaagagagtgggggccaatattcaacattcttaaagaaaagaattttcaacccagaatttcatatccagccaaactaagcttcataagtaaaggagaaataaaatactttacagacaagcaaatgctgagagattttgtcaccaccaggcctgccctaaaagagctcctgaaggaagcactaaacatggaaaggaacaactggtaccagccactgcaaaatcatgccaaattgtaaagaccatcgaggctaggaagaaactgcatcaactaatgagcaaaataactagctaacatcataatgacaggatcaaattcacacataacaatattaactttaaatgtaaatggactaaatgctccaattaaaagatacagactggcaaattggataaagagtcaagacccatcagtgtgctgtattcaggaaacccatctcatgtgcagagacacacataggctcaaaataaaaggatggaggaagatctaccaagcaaatgaaaaacaaaaaaaggcaggggttgcaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtaacctacaaagagacttagactcccacacaataataatgggggactttaacaccccactgtcaacattagacagatcaatgagacagaaagttaacaaggatacccaggaattgaactcagctctgcaccaagcggacctaatagacatctacagaactctccaccccaaatcaacagaatatacatttttttcagcaccagaccactcctattccaaaattgaccatatagttggaagtaaagctctcctcagcaaatgtaaaagatcagaaattatggcaaactgtctctcagaccacagtgcaatcaaactggaactcaggattaagacactcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccagaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaagagagaagaatcaaatagacgcaataaaaaatgataaaggggatatcaccaccgatcccacagaaatacaaactgccatcagagaatagtacaaacagctctaagcaaataaactagaaaatctagaagaaatggatacattcctcgacacatacaccctcccaagactaaaccaggaagaagttgactctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggattcctccccaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttcgggccagggcaattaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctgaggacacaaaatcaatgtacagaaatcacaagcattcttatacaccaataacagacaaacacagagccaaatcatgagtgaactcccattcacaattgctacaaagaggataaaatacctagcaatccaacttacaagggatgtgaaggacctcttcaaggagaactacaaaccactgctcaatgaaataaaagaggatacaaacaaatggaagaacattccatgctcatgggtaggaagaatcagtatgaaaatggccttactgcccaaggtaatttatagattcaatgccatccccatcaagctaccaatgactttcttcccagaattggaaaaaactactttaaagttcatatggaaccaaaaaagagcctgcatcgccaagtcaatcctaagccaaaagaacaaagctggaggcatcacgctacctgacttcaaactatactacaaggctacactaaccaaaacagcatggtactggtaccaaaacagagatatagatcaatggaacagaacagagccctcagaaataacgctgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccagaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaaggattaatatccagaatctacaatgaactcaaacaaatttacaagaaaaaaacacacaaccccatcaacaagtgggcgaaggacatgaacagacacttctcaaaagaagacatttatgcagccaaaaaacacgtgaaaaaatgctcaccatcactggccatccgagaaatgcaaatcagaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgctgctataaagacacatgcacacgtatgtttattgcggcattattcacaatagcaaagacttggaaccgacccaaatgtccaacaatgatagactggatgaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcagtcataggtaggaattgaacaatgagaacacatggacacaggaaggggaacatcacactctggggactgttgtagggtgggggaaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaattaaaaaaaaaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagttatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagtttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtttagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttgaa

SEQ ID NO: 285 - DNA, 42247 bp, Homo sapiens
gcttaacatcctacaaaatgatttaaaattattgttatatgcatttatcttcactctgatgagggctcagacttgataacacccgtggtgccccatccctataggagctggtgagattgcagcctgctgcctcccctccaacagccacagctattggatttcccacccagaatctttaggtaaatgaggtaagtcctgatttttaaaacttcttttgaatctggaatccaaacacttgagtggaaagagaagcctgctttaaactggacagatgaaactagaacagactcttggagacggctggcaggaagtgaagctcaccttacctgggcttacctcactgggtcaaatcagaattttattttggagggcaggttggctactttggatattatctgtgaatttcctgcattgtctggacttctaatctctgtgaatttaaaagccccctcgtttccctatgcctgggtggcaaaaccattcccctgggttgaattcttctggaacaaataggcagctagagataggtggctctgatatagctcagagaagaagtggttggctaagtagctgttagggctcagagtacacggtctcgctttctagagatgtcttctgctggtaatttttctgacttatgagctacatggaaaggccaatttgtttttaatatgttccaggactggaaaatggctagaaataggcaagaacatacacaatcacactggaaaaagtggccaggcagccaaggcaggcagaggtattggggagagctgaatatctacaaaaacaaaaattcagaaaaaacaaaaatcaattttggcaaagggcttcactgtataacaaggggacaagctaaccctttgtttacaaactaaccctttgtttactccattttgtccagaaaatacaacaatcagttttggcaaagggcttcactgtgtaacaaggggacaaactaaccctttgtttactccattttgggagactatgatcagacaggcagttgtgactcagcagcaacaaatgccttctgagacagggattcttttgattttgcttggacattgtggagaagtgttagccccaatgtggactgatctgggaacagtgggaaattaacttcttgttggtaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggaggtaaagatgtgttgatagtctttcaatgtgtaaaagggcaattagagattctgtgtgactgtgtgttaattccactggggtcaggggaaaaatttatttctaacagaaaagaagaagatacgttattaggaagaatttcatggctaggagatactatcagaaaaggctcttaagagattttaaggatgactttaatagctgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatacttcaccgtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatcttggctgactgcaacctccgcctcccaggttcaagtgattctcccaactcagccccccgagtagctgggattacatgtgctcgccactatgcccagttaagttttgtatttttagtagagacggggttttaccatgtcagccaggctggttttgaactcctgacctcaggtgatccacctgcctcagcctcccaaagtgctgggattataggcttcagccaccgtgcccagccatattgttttcatttttaatctattagtctatcgtgatctcccagtggaagtatctttggcctttgtggacgtcaggaaagccctacattcccactcgcgattccatgtttatgggtaccctaaatgctcccattaattgaccaactttaccctgatcttctttcaatatctttctgactccttgaaggtatgagacaaaatggaaactgagaggttaaaaggtttactaggttgcattcaattagcgaattggaaactggaaggagctcctatcgggtctcaggtcagaacgtgagtgcttttggccaaagttcacttctgaggaagtagaatttcgctttctggaatcttgcgatattttatttcctctatatctttcccatgcccccgacccacccaatctccacaaatttggggatttgagcactgggttgtgatcgttagaccatcttgcttttctgaaagcccagggcaagacccctgcttcatgtcacagtatcaaacacagacatagaagcttgtacaaattattgagaagttattgtcttttctcccttcctccatatggagtcatctctatgccctttcatacagatgtgatttacgaagacctctgggttaggggtggggtggtgagcaagaatcccgtggcagaatctgctaacacacttgagaagcaatgttgtggttttaaggaactcaatctaaagcttgaacctgattttcagggataccattttgctgccgtttcagcccatttctcttgttaagatcgctctctggtagagttgacgtgacactcatttctgttgtgggtggggccctggttgggaggcattggctccactgcagcctgggtgtctagagaccacattctcaccctgcctttgttactgggaaaccgaacgcggcgctgtggctttcagcttgggtaagccgggtctgcggcggggattgccatctgaagacagaggcaggagggcagccacaccttgcccaggttctcttaaatctcttgctctataactgaaaggagggcatagataattaactttatttgacatttttcatatctaatttttaagaatatgattttaaaataatagatttgttctaaagagcaaacaatcttgctgttattaaaaacgtgtttacttaaattgaacggggtttcaaagggccaagctactaagctgtgcaggaaacaaacagtgcagtgaggagaatggctcctcaccacagctattcttagggtgggacatagtttcaagccaaatgacattgatgtccggaaaccaggatgtgctgaagtagaaatttccagggatccctcagagttatttgctaaaatgtttattattcttcagaggggggtggaaatatttctttaagagtcttccttgaagaattttgaactccagctttggagtgatgggagcacagtgcagggaaggcgggatgtgaggtggtgtgctggacggcagtctagggacctggtctagcactggcagagctgtgtgtcccagagcacacattcccctttgccaggctttagtttcctcctctaggcaaaagggtttgaacctgaccatctttaagatccattttaaccctcagattctgtggctgtggtgattgggggtggtgggagtacctgggggtcagcaggataagcacgaatctgtgagagctgagaacaggtgggagaagccttctaaggatgaggcaggaaagattagcaagagcccttaaatggattctttagggccttcagaattttggctaaaggctatactagtggaggtactaagacctgacacctggagcctttattaaggatgttagaatccactcccatgacaacatcccagctttgccaatttgcctcatgtgtctcaagctggtgggaatgtagaagtggatgaaacagactgttttgtgatggcagggaacagcctatgcacaggggcaggtgctctactggtgtcttctataaaacgccaaagcagcccgccagaaaatggacatttaggcactcgtggtgtctactgagtttgtatggtactgatgagcttgcttgactgattatccatgacttactgagtagatcgaacgtatgtggactcacttctcctagaggaagaccctgtggctgccccagccactgagcagcctaacctggagaccctgatgtgcccagaaagcgtcaaccttgtatctggagaaaccagaacttgcaacagggccaagcagggtggcccatttaaagaggctcctagggttttaattgaccttgttttaaaagagacaccctgtaaaatactcctatgaaaacttatttcacaagcacctaaccgcattctgtctttggtttgttttacggggccgggccccttgttctggtcaattggtctgcattatctctcctcctccaatctcaccacacaccctggcctctgggaggcttcctcccttctttttttttgtttgttttgtttttttagcatcttagttgttactaggggtacttgcctacttatttaaaatatggccagtataggtgcatacaaaatgtgctttctgattaaaacaaagccaaaaataaaaagaaaccaaaatgcctattatagtagttggatttttagactaacagaccacctcattaaccctgtcattttaccataacaacttatttttatctttgtatgaccttgtctcaatgtcctttttctttgatgttgttgcaattatgaacatcaaatttcatagctgcttttccaccccactttctatcacagaagcacaataaataatcttgggggctgggctcttgttggcccaactgtggcttcaaaacatttcagttgcctgtccagccctttcttagcctgatacaacatcccccaaaagtctgttgagcttttcctggaataagaagagggtcttctactttttgaatagagcaatggagattggagaatatggtcatcttgtggaggttattccaggcttcttcttaggaaccttaaaaaaaatctcctcagtagggctgatgatatattctggacaataaggtgagcagagtctgaaagatgagagcaattttcaatcttgtcatgatttcatctagtcagcctcatttcatctagtcatgaggctgactaatgataagacttgctttgtctttgcagtgtactctagatttgactctaaattcagcctctgtcttgatcatgcccacttagaaaattagagtgcagctagctcaccttttagtcatcttaattccactaggcagaaggctgtgggtcaaggaatgttgatggagtaaaatttgactgcatgtgtatctgaaggggtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatattaaattctgggattttggtttgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcagaaaatactgattctcctccaggcagttcacatgactagcttttaggagtgagtataccgttgcccacccctaaaattcttgatcatgtctccagatgtctactgaccactgatgctgaggtcatgaatcttgggcattctagaggctttgggaaaaaaaattctacttacttcttttgcccagacactctggggtctacctcttggtaaattattcaaatgaggtttctggtcatgcaaatgtggtttctagagcctatttgaattgaacaagtagttcttattattagtaaaacagcaaggatccctaacttggggtccaagggtaaattcagggtttctgtgaacttggatgtaaaaaaaaattgtctttattttcaataatctctaactagaatttaacattttctttcaatatgaatgtaggcaaaactccatggtagtattagctgcaattgtgactatcaccaggataaatcacattttcatgtcttattacacctattacatatatcacaaaaagtgggtatttgatatcaagttagatctgcactaggtagatattcttatttaatgtattaacaaggaagcacatatattgttatcaggttggtgcaaaagtaattgtggttcttgccattaaaaataattacaaaaacagccagtctggccaacatggcgaaaccccatctctactaaaaatacaggtgtggtagcacacacctgtaatcccagctacttgggaggctgaggcaggagaatcatttgaacctgggaagcagaggctgcagtgagccaagatcacaccactgcactctagcctgagcaacagagtgagactctgtctcaaaaaaattaaaaaataaaaaaaaactctgtaattacttttgcaccaacataatatgatatcacacatttattttaaaaagtattttgacattgtcttttaatataaatttttttaaatcttataatattttaatttgtcatgtaaaaatattattttgagaagaggcctgtaggcctcactagattacaaaacagatccatcgtacagatgaaaggttaagaacacctcatttacagcattctctcacacacgactaacgaaatgacttctgaacagcgccagttgatagatgttctctgccaaaaggggaatatgatcttcccatatgttcctgcctatgggtagccttggagttgtgaagggactttggcataatgaagatgataataagaatgataatggtaatttgttgagtgcctgctgtaagccaggtggttacagtcctgttcaatgtcatgtttagtttaatcctcccaatgacctcaggaggtagtgcatggaacaaagacagaagagatcccctgcccacccacggtaatgaaacatgggtacaggtgaaggcaaaagtggggactgaccctttggagatggctgatgtcacgagtgtgcaacctgtgcagttccacggggccccatgcttagaaaggttccatgtttggtttaaggctctgctgttgccatcttaaaattcttcgtaagttttgaacaaagggccctgcatgttccttttacactgagctctgcaaatgatgtagctggtcctgcctctggttatggtgaaatggaatgtatgacaactcctgagactgggagtctgggaagctgctgcggagagccctctcctcattttcatcaggctcagctacgcaacctctggtggaaagctatggcctgttgaggagggaggatgtcgtttttgagttagtgagttttccagttttgtttgagctccaaagctttcctccaaacaactggaaagatggctgaataattggctgaaagggatttaatcccttgaaaaacctttctggtagggagttgctggcaatactggtgggtttttcatgattttattttacagagggcttgctacgtaaaccagtgagccaggagaaacagaataaagtctgttctggaaggaaaaatgagacctggtgtgccacgagtctagtgttctcataggaaggctctaaaaacaaactcagctttcctgctattgaatgattatctctataaaaggaaactttacttcttctaaaggagaggtcgtctaatttgtgagaaaattcagatgttatttgcttcttaagctgcaaggatgctaatgaaataattctcatgaagttctgttggtgttttagggctaagtttttatagactgttccaaaattcaaaacagggatgtggacgtagtgatggtggaagaggggaagacttttcctcgatttctttgcctgagggatggaattcaggctcccccaataacatattcatggtctttctctggtcagtcagtgatgttcataacacaagcaagcctgtcatcaggaccaatctgtgatggctgagacatcaggtgctcttccaaaagagccataattcacccttcatttcccaaggttttttttttcttgctgttattactgctcttttatcatggttaataagtctgaggtggcttcagacagccagtcctaacccctgagtcaatctggggcctctaacaggaagccagactgaagttctgatagatgggtttgagtggctgtgaactgtgtttctgtagcatccagactgatttgcactgaaagggagcttccatattagggtacaaggatgatcaatatgtctcctgtttatatttggtggaaaaagttgtgggaatcgtgcttaaaggatctcaactttgaaattaaaagtataacgtcctaacagacatcctccttctctttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaacactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgcgagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccaataggccttactcagaacaagaggagccgtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaactgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggcatctgaatgtaccatcttgtgaatgtaccatcttttaaacgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccacacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaagagatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttctggaattgagattaagagctgaggccagcatagctctcgacttctccttcccccagtggtccttagcattatgtgtcacttgaggtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgacagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacgcctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttggcaatttcctctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaa

SEQ ID NO: 286 - DNA, 42247 bp, Homo sapiens; identical to SEQ ID NO: 285

SEQ ID NO: 287 - DNA, 30824 bp, Homo sapiens
aacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgcgagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccaataggccttactcagaacaagaggagccgtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaactgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggcatctgaatgtaccatcttgtgaatgtaccatcttttaaacgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccacacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaagagatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttctggaattgagattaagagctgaggccagcatagctctcgacttctccttcccccagtggtccttagcattatgtgtcacttgaggtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgacagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacgcctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttggcaatttcctctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaa

SEQ ID NO: 288 - DNA, 32872 bp, Homo sapiens
agttccagggaaggagggcgtagacaaagcgccacctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggtactggatcccgggctaagctcgggaggaggtcccctttggtggggccatttcgggaaagtatgtcaggacgtaagtgcttcactgaagacaggatctgattttttcctaactggttccctatgtcctgccttctggtgcgttttctttagatcttggactactacgggccaacattagctaacatttatggagcaccgttttaagcacactatatgaatcgattaatccaccaaaatcccaagagctaggtaggatgacaacccccattttattgatggggaaccctaaagagctccggcggtgctgcctgctgcaactcctgcctgatcaatatggttgcagtcagctatagactgttttactgagaccggacaacattagttcagtcgtttgtggtaaacatctacgtgtacaagcacactttataaacatttttttctttctttttttttttttttgagacggagtttcgctcttgttgcccaggctggaatgcaatggcccgatctcagctcactgcattccacctcccgggttcaagcaattctcctgcctcagcctcctgagtagctgggattacaggcatgcgccactgtgaccggctaattttgtatttttagtagagacagggtttctccatgttggtcaggccggtcttgaactcctgacctcgggtgatccgcctgcctcggcctcccaaagtgctgggattacaggcgtgagccaccgcgcccggccaaacatttttttctttcaagacggaggcttgctctgtcgcccaggctggagtgcagtggcgggatgtctgttcactgcaacctccgcttcccaggttcaagcgattctccttcctcagcctcctgagtagctgggattacaggctcccgccatcatcatgccacactaatttttgtgtttttcggagagacggggtttcatcatgttggccaggctgctctcgaactactgacctcaggtgacctcctgcctcagcctcccaaactgctgggattacaggggtgggccaccacacccggcctggctcagcattttgggaggccaaggcgggaggatctcttgagcccaagagttcaagaccagtctaagcaacatagtgagaaacccataccgatctctacaaaaaaaatagaaaaaattagccaggagcggtggtgcatgcctgtagccccagctgcttgggaggctaaggtgggaggattgcttgagcccaggaggttgagactgcaaatgagctgtgatcaagccactgcactgcactccagcctggatgactgagattgaccctgtctcaaaaaaaaaaaaaaaaaaaaaaaaaaaatgtgggacagataaactggaaaatcaagatggcccagagtagacagacaaggctggggaggttgtgtgtgggaatggcagtcgggaaatgctttatagagtgtctgggcctgaaagggtagaaagacttgggaggggaattccagttaaaggaacaactggagcacaagcttggtgctagaaaaagaaggaagtgtgtagctacaattcatgaaagatgggcaaaaggggagtattagaatataaaactggaaagtatttcctggggaaagccagataagcaggaccttgaatgcaaagctaaatcatttgaattatacatagaaaagaaaaaaaaaccggggagagtttttaagtaggaaagtgataagacattgggggataagatggagacaagggcattaattagattgccatagtagtttaggcaagaggattcaatgctaacaagtataatggcagtggaagtggaaaagaggggatttaggttaggggtctccaactcacgtacagaaatcagctaagtaatgtaggtaagtgaaatgaactgagttgggactctggtgaactgggcagccctttcacagctccagctgattgttgccttgcgacaatattgtctctgtgtgatcagatagtcagttttcaaaagaatccagaagtccagaattgtgtatttactcacgttgaaatgttgaatttaaaattttttggccgggcgtggtggctcatgcctgtaatcctagcaccttgggaggccaaagtgggcggatcacctgaggtcaggagttagagtgaaggggtgggttgcccctccacacctgtggatgtttctcctaaggtggaacgagagacttaggaaagaaaaagacagagacaaagtatagagaaagaaataaggggacccggggaaccagcgttcagcatatggaggatcccgccagcctctgagttcccttagtatttattgatcattcgtgggtgtttctcgaagagggggttgtgtcagggccacaagacaatagtggggagagggtcagcagacaaacacgtgaacaaaggtctttgcatcatagacaaggtaaaggattaagtgctgtgcttttagatatgcatacacataaacatctcaatgctttacaaagcagtattgctgcccgcagatcccacctccagccctaaggcggtttttccctatctcagtagatggaacgtacaatcgggttttataccgagacattccattgcccagggacgggcaggagacagatgccttcctcttgtctcaactgcaagaggcatgccttcctcttatactaatcctcctcagcacagacgctttacgggtgtcgggctgggggacagtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatctcgcaccgcccttaatccattgaaccctgagtttgacacagcacatgtttcagagagcacggggttgggggtaaggtcacagaatctcaaggcagaagaatttttcttagtacataacaaaatggagtctcccatgtctatttctttctacacagacacagtaacaatctgatctctcttgcttttccccacattagagaccagcatggccaacatggtgaaaacccttctctactaaaaattcaaaaataagccgggcgtggtgtgggtgcggtggcaggcgattgtaatcctagctacttaggaggctgaggcaggagaagtggttgaacccgggaggtggaagttgcagtgagccaagatcaccccactgcactccagcctgggggacaagagtgagtctcaaaaacaaacaaaaaaccaaaatatgcccgtgggccaaaggtggcctttgattgtgagtttgcaacctcttgtgagtgacatagaatctactagaaaagagggcattttaaaaaaagtaggctgggtggagcggctcacgcctgtaatcctgaagggggccagcccctccacacctgtgggtatttctcgtcaggtgggacgagagactgagaaaagaaataagacacagagacaaagtatagaggaagaaaagtggacccggggactggcgctcagcatacggaggacccgcaccagcactggtctctgagttccctcagtatttattgatcactatctctaccatctcagccagagggatgtggcaggactatagggtaatggtggggagagggtcagcaggaaaacatgtgagcaaaggactctgtgtcataaataagtttaaggaaaggtgctgtgccttgatgtgcacgtaggccacatttatgattgactttacacaaacatctcagcgcagtaaagagcagtattggccgggcgcggtggctcacgcctgtaatcccagcactttgggaggctgaggtgggtggatcacgaggtcaggagttcgagaccatcctggttaacatggtgaaaccccgtctctactaaaaatacaaaaaaaaaattagccgggtgtgatggcgtgcgcctgtagtcccagctacttgggaggctgaggcaggagaatggtgtgaaacctgggcgacaaggcgagactctgtctcaaaaaaaaaaaaaaagcagtattgccgccagcatgtctaacctccagccataaggcggttttctcctatctcagtaaatagaatgtacaatcgggttttatacagagatattccattcccagggactagcaggagacagatgccttcctcttatctcaactgcaaagaggccttcctctttcactaatccttctcagcacagaccctttatgggtgtctgggggacggtcaggtctttccattcccatgaggccatatctcaggctgtctcagtggagagaaaccttggacgatacccaggctttcttgggcagaggtccctgcggccttccgcagtgcactgtgtccctgggtactcgagactggagaatggcgatgacttttaccaagcatactgcctgcaaacacatttttaacaaagcacatcctgcacagccctaaatccattaaaccttgagtcaatacagtgcatgtttctgcgagcacagggttggggctagggttacagattaacggtgtttcaaggcagaataatttttcttagtacagatcaaaatggagtttcttatgtcttcctttttccacatagacacagtaacagtgtgatctctctttctttcccccacataatcccagcactttgggaggccaaggcaagcagactacttgagcccaggagtttgagaccagcctgggcaacatatggagcccgtctctacaaaaataaaaattagctgcgtgtggtggtgcatgtgtatagtcccagttctgggggaggctgaggtggggaggattgcttgagcccaggagttcaaggctgcagtgagctttaattgtgcaacaaatagaggccctgtctcaaaaaaaaaagagggtttcactcttggtcactgtaacctcaaactcctgcacacaagcaatcctctgggctgagctgggactacaggcatgggccaccgtgcccagctaatctattttgctttttgaatagacagaggtcttgctgtgttgcccaggctggtctcaaactcctgggctcaagtgattctccagccttggcctcccaaagcaatccctaggtaacagactcagtctggcttcctggctctggcttcttcccttctagttcattctccacactgtagtcagagtgatctttacgaataaaaactctggtcggtcgggcacagtggctcatgcctgtaattccagcacgttgggaggcctaggcgtgtggatcacttgaggttgggagttcgagaccagcctgaccaacatggagaaaccccatctctactaaaaatacaaaatcagccaggcgtggtggcatatgcctgtaattcgagctactcaggaggctgaggcaggagagtcgcttgagaaaggcggaggatgcggtgagctgagatcgtgccactgcactccagcctggccaacaagagcaaaacctctctcaaaaaaaaaaaaaaaaaaaaaaagtctggtcaggtcccacttcagctcacaatcagttcagtgcctctccattgtctttaagctatagcccaaattgatcaatacagccattaagaagtgctgctaggccaggcgcggtggcttacctgtaatcccagcactttgggaggccaaggcaggcggattacctgaggtcaggagttcaagaccagcctgggcaacatggtgaaatcccgtctctactaaaaatacaaaaattagctggacatgttggagtgtgcctgtaatcccagctactcgggaggctgaggcataagaattgcttgaacctgggaggtggaggcaacgatgagctcatcgcaacgatgagctgagatcacgccattgcactccagcctgggcgacagagtgagactctgtctcaaaaaaaaaaaaaaaaaaaaaaaagccctgcttctaacagggccaatggctcacacctgtaatcccagcactttgggaggcgaaggtgagagggtcccttgaggccagaggtttgagaccagcctgggcaacatagtaagatgaaacccccatctctacaggaaaaaagcccttcctccctatcgccacccctcccccaagcctaaactaccccttctcacccacagtcaactccctggggtttgattttatctaggtaaatcatcctgctatctctattgtctagcagaatacaattcacaaataggactcaatatacatttattagttacctctataagtttttttcagtttgcctctttatgttgggaatgctgtaaatttttaaatgatcttttctcagccaattcattgactgtcctaccttaccaaatgattttgctcttagagaggtctggagagtgtttgttcaaggagcaaccctgcccccacctggcagcaagaggcactgcctcaattaatagaggagaaggatatgcaaatgaccagtgcttgtcagggaactggcagagacgtgacagtggagaaaaggctcaaattctttttgagatggggtctcattctgtcacccaggctggagtgcagtggcgtgatctcagttcactgcaacctctgcctcccaggttcaagcgattctcttgcctcagcctcctgagtagctgggattacaggcgctgcaaccactcccagctgatttttatgtttttagtagagacggggtttcaccatgttggccaggctagtctcgaacccctgaccttaagtgatcagcctggcttagcctcctaaagtgctgggattacaggcgtgagccaccactctgggcctcaatttcttttctttttgaaccaggatctcactctgtcacctaggctggaatgcagtgtgtgatcacggctcactgcagtgttgaactcctgggctcagaggatcctcccacctcagcctcctgagtaactgggactgtaggcatgtgccatcacacccagctaattctttaattttttggagtgtgacagtgcctcactatggtgcctaggcgggtctccaactcctgggctcaagcgaccaaattgctgggaaacaggcatgagccactatacctggcccaacataaatagaatttcctgggttgtggaggagtgtgacattgaggtggtcttccagggaagaggtgcttttacaactgcagtgggtaacatgggtatctgggctacctgctcatgcaatgtactaatgttttctggttctgctttcagcttcatcatgaatataccatttccatctttatatctgactaaagggtctgtctgactttatgacttgataggtctgacaagacccaattcataatggggcagttctggatgcttcatagtcaagctttccagtaacagccctgatgctgtttctcaaaaggcacctacttccctgctttggacagcttggccttgctccagaatctcagggacttgcattgtgcttttgccataggagcttgccataagttctacactgaatctttttttcgctactgatactttgaacccccaggatctgctggattgcatggcttaagtgtgcattgcatcctagacttgatgcagagccctttcctgctcagagtttgagtcaaagttggcagcttagccggtatgtgggctggagatatatttctaagtctggatgtgacagacaccacacccgtgcattctttttgtctttaatggtggcactaatctctgtccctccccaggatgtgatactgcttttgatttactatcatagctgaagagagggaggggttttagagatctctttgtctgtcccactatgataggtcttacctcttaggccaaggacccaatgcgattacttcaactcctaagtatatcaatcctgttaaatacttggttttttttttttttgagatggaatgtgctggcttgcagtggtgccatctgggctcactgcaacttccaccttccgagttcaagcaattcttggtcctcagcctcccaagcagctgaggctataggcgcgcaccagcacgcctggctaattattttttttatttttatttttatttttgagacggagtctcgctctgtcgcccaggctggagtgcagtggcgcgatctcggctcactgcaagctccacctcccgggttcacgccattctcctgcctcagccttgcgagtagctgggattacaggcgcccaccaccaagtctggctaattttttgtatttttagtagagacggggtttcactgtgttagccaggatggtgtcgacctcctgacctcgtgatccgcccgcctcggcctcccaaagtgctgggattacaggtgtgagccaccacgcccggccgctaatttttttttttgttttgagacagagtcccactctgtcgcctaggctggagtgcagtggtgcaatctcggctcactgcaacctccacctcctgggttcaagcaattctcctgcctcagcctcccatgcccagtccccgtttaaacacttggaactgaggaaatatctagtgatgggtccatggacaagcagacttactatgagctagtaagttttggctaggacttcagttactgcctgacacctgtaagtccccactgtaatgtgggaatcatgatgaagctttgggtttccaggtctcaatgtcagctcagatcttgtgcccaaaatcctcaaagtgtttaggcatttccctttacccagtgtaccgttatctgagtaagtgatatgttgacattctcccttttaggaggaactggcagaaccgttacagttttagcatcctttcgtagggatttgtgtacctcttcagtaattgagttttggatgtgaaagttgtttcagccaggtgcggtggctcatgcctgtaatcccagcactttgggaggctaaggcagtcagatcacttgaggtcaggagtttgagaccagcctggccaatgtggcgaaaccccatctctactaaaaatacaaaaattagctgggcatggtggcgtgtgcccgtaatcccagctactagggaggctgaggcaggagagtcccttgaaccctggaggtggaggatgttgcagtgagcctagattgcaccactgcactccagcctgggcaacagagcaagactctgtctcccccacaaaaaaaaaaaaaaaaaaaaaagttggcttagatccaggagctgaatcaaggattttgcctgtttattgtggtgattgcccttagctgcctcttcctcctctattcttgcctttttctgtttgtagatgcttagtagcatcctttttggctatccgcatatttttcccctaaggatgccatgctctattgtatccacaactctgtgaatcaaacgcctcatggctacccctgcaacattgacagttttatggtagttgcatatttctggcttttggcagctaagcaatgctacccagcctctgttacgtgttgggagatacttccccgtatatcttgagtagctcagctctgactgcttctcctgtcatcagctgtggactgctcagaagccaccactgaatttctaagtgatgctgatgtccaccgatgtcaccagtatattcttgatggtcttgtaaatgtgtccttcgggtcctttcttggaacaccattctctggtctcacatagtacagtatagtacgtatatctattccagcatgcccacttttttcagccactttttttttttttttggatggagttttgctcttgtcgcccaggctggagtgcaatggtacgatcttggctcattgcaacctctgcctcctgggttcaagagattcttctgcctcggcctcccaagtagctgggattacaggtgcctgccgccatccccagctaatttttgtatttttagtagagacggggtttcaccatgttggccatgctggtcttgaactcctgacctcaggtgatccatcctgatgggaatgttaattgtggtagtttctttgcttttttttggcaggtgggggggtggtctcactctattgcccaggctggagtgcagtggcacgatcttggctcactgtaaactctatctcctgggtccaagctactctcgtgcctcagcctcccaagtagctgggattacaggtgtgtgccaccaaacctggctaatttttgtatttttaatagagatgggccttcaccatgttggccaggttgattgcaagctcctgacctcaggtgatccgccctccgcagcctcccaaagtgctgagattacaaggtgagccaccgcatctggccctgcttttttggtctgtgagccagaatagtatctgttcttatcctctaacatctcatcagttctgtacttgaggatactttatcagatagatttttggaacagggagattgaataaaaacttaaacttgctcatcctttttacaagtcaatatagtattgcattacctccatgaatgctgtggttctaccttttggggcagatgtcagttaaaattcagactgtcacattccaccgtatcttttggtttctggaaaaaactttaaggtgaatctgctatttcttttttcttctttttctttttctttctgtttttttgagatggagtttcttgttgtgcaggctggagtgcgatggactgatctcggctcgccgcaacctccgcctcccaggttcaagtgattctcctgcctcagcctcctgagtagctgggattacaggcatgcgctaccacgcccagctaattttttgtatttttagtagagatggggtttctccatgttggtcaggctgatcttgaactcctgacctcaggtgttgcgcccacctcggcctcccaaagtgctgggattacaggtgtgagccaccgtgcctggcctatttccctttattctttctcttttcttttcttttttttttttttttttttttgatacagagtctcgctctgtctccaggctggagtgcagtggcccgaccttggctcactgcactctccgcctcccgggttcaagctattctcctgcttcagcctcccgagtagctgggattacaggcgtgcaccatcacacccagctaatttttgtgtttttagtagagacgtggtttcaccatgttggccaggatggtctcgatcccctgaccttttgatctgcctatctctgcctcccaaactgctgggattacaggcgtgagccaccgtgcccggctgcttccctctttctttaaatttaatttaatttttaaaattaagatgtttatctcactatgttgcccaggctggtctcaaactcttggccacaaacaatcctcccacctcagcctttcaaagtgctgggattataggcatgagccaccatgcctgaccccttttttctttaacattatgtttttgacacatttttgcctatcttttatgtcctggttctttcaaatttagtcatttctagtattctagttagaaattttctacaaattattttacaaatgttctacaaattatttttcaaaaaaaattttttttttttgagacagtctcactcttgtcgcccaggctggagtgcaatagcatgatcttggctcactgcaacctcttccacccaggttcaagtgattctcctgcctcagcctcctgagtagctgcgattacagcctcctgccaccatgcccagctaatttttgtatttttagtagagacggggtttcacagtgtggtccaggctggtctcaaactcctgacttcaggtgatctgcctgccttggcctcccaaagtgctaggattacaggtgtgagccaccacgcctggcctatttttcaaatttccaaatttttactactataaccagtgctgcagtgaaatcttttatatattgttttgtgtacatgtgtgagagtttctctagggtatgaatctagctaggactgttggtgggtaaaagggtattttcattcttttttttttttttttttgagatggagtctcactctcttgcccaggctggagtgcagtggcacgatctccactcactgcaacctctgcctcctgggttcacgccattctcctgcctcagcctcctgagtagctgggactacaggcgcccgccaccacgcctggctaattttttgtatttttagtggagacggggtttcaccatgttagccaggatggtgttgatctcctcacctcgtgatctgcccgcctcggcctcccaaagtgctgggattacaggcgtgagccaccgtgcccggccaagggtattttcattctataggcggttgcaaattgctctcctagaacggatgtaccaactaatgttgccacttatgcaatttgtatcctcctaatcacttggtttagtcagatgttttcatattgccaatctgacggacatgaaattctattttcttgccattttaatttgcactttccagattactaatgaggttttgtaatctttaccattcttttgtatatctaattttgtgaattggcttttttgtttttgagacggtctcattctgtcgcccaggctggagtgcagtggtgtgatttcagttcactgcaacttctgcctcccgtgttcaagtgattctcccacctcagcctcccgaatagctgggacgacaggcttgcaccaccacgccccgctaatttttgtatttttagtagagacagggtttcaccatgttggccaggctggtcttgaactcctgacctcaagtgatccacccaccttggcctcccaaagtgctgggattacaggtgtgagacaccacgcctggcctgaattggctatttctattatgtgattagaatagaatttctatttggtgggtgccgtggcttacatctgtaatccctgcactttgggaggccgagatgggcggatcacaaggtcaggagatcgagaccatcctggctaatacggtgaaaccctgtctctactaaaaatacaaaaaattagccaggcgtggtggcgggcgcctgtagtcccagctactctggaggctgaggcaggagaatggcatgaacccaggaggcggaggttgcagtgaggcgagattgcaccactgcactccagcctgggtgatagagcgagactccatctcaaaaaaaaaaaaaaaaaaaaaaagaatagaatttctatttggtgattttttttcttgatgattattggtttttttcgtactggtttttagtgataatttatatgtttcatctactttgttagctatattagtttcagatagtatgtcttctatttgtggcttgtcttttcagtttgttatggcaaattgtgatgcataattttttctcttttaatgttgcacaatttatttgtctttttcttcatgatttattcttttgtgtattttttttttttttgagttggagtcttgctctgtcgcccaggttggagtgcagtggcgcgatctcggctcattgcaacctctgcctcccgggttcaagctattctcctgcctcagcctcttgagtagctgagattacaggtgcctgccaccacgcccagctaatttttgtatttttagtagagacggggtttccccatgttggctaggctgctctctggccaggcttgtctcgaactcctgaccttgtgatctgcccgccctggtctcccaaagtgctgggattacagacgtgagccaccgcacctggcctcttttgtttcttctttaaaactcttttcttatcctgaggtcagaaagatattcttatttttttctgaaattttatttatttacttatttatttatttttttttgagacagagtctcactttgttgccagcctggagtgcagtggcgtgatctcggctcactgcaacctctgcctcccaggttcaagctattctcctgcctcagcctcccaggtagatgggactacaggtgtgcgtcaccacgcccagctaatttttgtatttttagtagagatggggttttttttaccatgttggccaggatggtcttgatctcgtgaccttgtgatccgcccgccttggcttcccaaagtactgggattacaggtgtgagccaccgcgcctggcctatttgattacttagaatataattttgtgattggtgtgaagtagtgatctaattttatttttttatagtaccatttggtaaatagttcattctttccccactgattatattatctctgtcgtatattgtttcaagtatgcatgagttatttttaggctcgttttctgttccgttggacacttgcccatccctgtgtctttagcatactatgattgttactttatacattattattattattatttttttttttttttgtagagttggggtctcactgtgttgcccagactggtctcgaactcttggcctcaggtgatcctcttccctcagcttcccagaatgccgagatgataggtaataataataataataattattattattattattattattattattattattatttgagatggagtcttgctctgttgcccaggctggagtgcactggcgcgatctccacttactgcaagctccgcctcctgggttcaaggttcaggtgtttctcctgcctcagcttcctgagtagctgggactacaggcgcccgccaccacgcctggctaatttttgtatttttagtagagacgagtttcagcatattggccaggctggtcttaaactcctgaccttgtgatccgcctgccttggcctcccaaagtgctgggattacaggcgtgagccattgcgcccggcctgattacaggtaattattcctttagcaaataacatgcctgctgcctggtagggcttatcttttttttttttttttggtgtgaagtcttgctctgttgcccaggctgcagtgcagtggcgtgatcttggctcactgcaacctctgcctcccaggttcaagcaattctcctgcctcagcctcccaaatagctgggatttcaggcacccgccaccatgcctgactaattttttgtatttttagtagagacggagttttgcctcattggccagcctggtctcgaactcctgatctcaggttatccgcccgtctcggcctcccaaagtgctgggattacaggcgtgagccactgtgcccaaccatactttatataatattattattattattatttgtagagacggggtctgactgtgttacccaggctggtcttcaactcttggcctcaagtgatcctcctgccttagcttccaagaatgctgaggttacaggtaattattattttagcaaataacatgcttgctatctggtagaatttgtctttaaaaatacgattttttttctttaaagatatctttactattctctgcccttttctcttgcacatgaattatagagtcatcttacaaagttctcaccaccagatattaagatttgtattagaattgcatttggatttttagattgtttggggagcactaatttctttatgacatcaaatctttattttattattattattattattttttgagatggaatcttgctctgtcgcccaggctggagtgcggtggcgtgatcacagctcactgcaacctccgcctcctgggttcacgccattctcctgcctcagcctcccaagtggctgggactacaggcacacaccgccacgcctggctaaattttttttgtatttttagtagagacggggtttcaccatgttagccaggatggtctcgatctcctgaccttgtgatccgtctgcctggcctcccaaagtgctgggattacaggcgtaagccactgcacctggccctctgcttttttaaaaaaagaattcattagctgagtgcagtggctcacgcctctaatgctagcactttgggaggcagatcacttgaacccgggagttcgagaccagcttggacaacatgacaaaaccctgtctctaccaaaaaatacaaaaattagccaggcatggttgcatgctcctgtaataccagctgttcaggaggctgaggtgggaggattgcttaagctgaggaagtcaaggctgtagtaagccaagatcacattactgcactccagcctgggcaacagagagagaccctgtctcaaaaaaacccaagaaacagaaaacagaatttgtctttagtttctctatagtccagcctccttttaagagacttggtgttgaaattaaccaattttttctttctttgagacggagtttcactcttcttggccaggctagagtgcaatggctcgatctcggctcactgcaacctctgcctccccggttcaagtgattctcctgccttattctcctgagtagctaggattacaggcatgtgccaccacacctggctaattttgtatttttagtagagatggggtttctccatgttggtcaggctggtgtttaactcctgccctcaggtgatccgcccgccttggcctcccaaagtgttgggattacaggcgtgagccactgtgcctggcctaaccaattttttagttgcagaatgagtgatatttcaaattcaattttctgttacagcataccatactctaaatatctacttctcaatattttatattctctttcaccttattgattataaaatatatatatatttttcagacagggtctcgctctgtggccttggctggagtgcagtggtgtgatctcagcttactgcaccctcaacttcccaggctcaagtgatacctcccacctcagcctcccgagtagctgggactacaggcatgtgcaaccacactcagctaatttaaaaaattttttgtggccgggcctggtggctcacgtctgtaatcctagcattttgggaggccaagtcgggcagatcatgaggtcaggagttcgagaacagcctggccaacattagtgaaaccccgtctctactaaaaatacaaaaattagccgggcatggtggtgggcccctgtagtcccaggtactctgggaggctgaggcaggagaatcacttgaacctgggaggcagaggttgcagtgagccgagatcgcaccactgcacaccagccagggtgacagtgcgaaactctgtctcaaaaaaaaaaaaaaattttgtacagacaaggtctcactatattgcccaatctggtcttgaactcctgggatcaagtaatcctcctaccttggccttgcaaagtgctgggagtactaggtgtgagccaccacacccggccagctaattaaaatcaaacttttttttatagagacacggggtcttgctacgtggccctgtctggtctcaaacttctgggctctaatgattctcccattttggcctcccaaattacaggcgtgagccatggcacctggccaggctcatcagttatttgtttttttgtttatttctaatttttattttaattattttagaccagttctagctctgttgcccaggctagagtgcagtggtgcaatcataactcactgtagcttcaacctcctgggctcaagtggtccctcccacctcagcttcccaagtagctgggaccccaggtacttgcaccatgcccagctaatttttttttttttttttttttttttttttttttttttggagaaagagtctcaaataatttatgtagatcttccctctgcccagagatacagagtttaactctgtacatcttgagtgcaggctgcgcttagtgattctcttcctcagagtgtgatgacaaagttttggagggccaggggagggagaaaatgaggatgcagtattgtgtgatcatgactgcagaaatagctgctgttggagggcctcagtgatcattttaaggtctcttattgctacttatcttttttgatgagattaagtattctgtctctgatcagttgaatatctgatgtcattaatccaaggataatatgttaaaagtactaccccatattttccacatactgacctgctatttctctggtgtttatcttttagtatttggtttcatttgagagaatggcttgctgcaatgtttttcatttgtctaacttacttgaatactggatacttttcagatggtgcatttatttctcttctcctaagagatgactttggttctatttctttcactctttctggcttttatccccactttgcattcttcaccctttagtaagacaaccctgacaggtctcttctttagcagccagtgtccctcctataggattcatagtaacaattaatagtattctgacatgggttcttcagatagtagctgcgaagtgaactgctttagttggagtctttttctctgctttaatttcagccacgctttgacttccaaatgctcaattcctcacccatctttcctttttctttttcttttttttttttttggagacagagtcttgctctgtcaccgaggctggagtgcagtgtaatctcagcttactgcaacctccgcctcccaggttgaagggattctcctgcctcagccaagtagctgggattacaggcacccgccatcgtgtgcgactaatttttgtatttttagtagagatggggatttgccatgttggccaagctggtctcgaattcctgacttcaaatgatctgcccgcctcattcttccaaaatgctgggattacaggcatgagccaccacactggcctcatttttcaaatggctaaaatcttcaagatttctggctgattggtattttagaggcagctttgatgttttgtttctgggtctttggaatagagtcttgggctttcgaagatttatggaggctgttggacagagacagtctcctgaagagtttctagctgtcctcccatcttctctctgcctttagaaatccttcttagatgtggccgggcacggtggctcacgcctgtaatcccagcactttgggaggccgaggcgagtggatcacgagatcaggagatcaagaccatcctggctaacatggtgaaaccccgtctctactaaaaatacacaaaaaaatcaaaattagctgggcgtggtggtgggcacctggagtccgcaggagaatagtgtgaaccttggaaggcagagcttgtagtgagctgagatcgcaccactgtactccagcctgggcgacagagcgagacttcatctcaaaaaaaaaagtccttcttagatgtttttagttgtttgtttatttttcgagatggagttttgctcttgttgcccaggctgaagtgcaatggcacgatctgggcccattgcaacctctgcctcccaggttcaagcgattctcctgcctcagcctcctgagtagctgggattacaggcagccaccaccatgcccagctcatttttgtatttttagtagagatggggtttcaccacgttggccaggctggtctcaaactcctgacctcaggtgatccgcccgcctcagcctctcaaagtgctgggattgcaggcatgagccactgcgcccagcctgtttgtttgttttcagatagggtcaccctgtcagccaggctggaatgcaatggtgtgattgtgatcacagctcactgctgcctcaacctgagggctcaagtgatcctcccacttcagcctccttagtaactgggaccacaggggtgagccaccatgcctggctaatttgttaatttttgtagagatggggtctccctatgttgccgaggctggtctcaaactactgggcttaagtgatcctcctgccttagcttcccagagcgctgggattaaaggcatgagctgctgtgcctggtcaatcctttttacatgtttgaggaaaaataaatgtcctgttttcaggctaagatcaagtaataatcctcatgtgttaggaagcatgtgacatggatttttgcagcagagggttagaaaggaactttctttatatacttggccccctgcatttcagggctccaccgccatctgtctgtctgagtgtaaagtggaccttattggcatctgggctgccaaactgctttttttcctttgctttgcccagccttctcttgaaggctaaattcttgaaaaattatattctttgtgttcctatagtaaatattaagctttatatcaacacatatggcaggatctgaggctctttactcacctctggtccatttctctagtcttttctctgtagtctttttgttttcctgtcctccatctcctaatttattagttttattattatattttatattatttttttgagacagagttttgctcttgttgcccaggctggagtgcaatggcgcgatcttggctcactgcaatccctgcctcatgggttcaagtgatttgtctgccacagcctcctgagtagctgaaattacaggcacgcaccaccatacctggctaatttttgtatttttagtagaaacggggtttcaccatgttagccaggctgatattgaattcctgacctcaattgatccgactgcctcggcctccggaagtgctgggattacaggtgagccacagtgcctggcagtttgttttattttggttgaacagttacaagtcttggtttgttttcctgcagcaacaggtttatcttgatatgatacagcgttatttaaattccttttcattttcctgcctttgtcttcacatgctagtttttttcagttgtttcttttttcttcttccttttctttttttttttttttgagagatagtcttgctgtgttgtccaggttgcagtacagtggtgcgatctgggctcactgcaacctctgcctcctgggttcaagtgattctctcacctcagcctccggagtagctgggattacaggtgcccaccaccacgcctggctaatttttgtatttttagtagagacagcgtttcaccatgttggccaggctggtcttgaactcctgacctcaattgatctgcctgccttggtctcccaaagtgctgattacaggtgtgatccaccgtgcctagcctgtttagttgtttctaagaagggagatattggttttgattgacatagttcatccacttatttaccaaacacttgcgaagtgcctactatatgctgcctccgaataggcaggttcgtccacaatagcacaaggctcctgccacttgtcttcaaggacaaagagacatccagacaaacaaatgtaataaacaaatgggacatgattgtagcagaggcagatgcatggtggagggaaagtaattttgtctggggagttgagaaaagctgtcacttgagctagatcttgaatgaataggaactcatgaggttgagtggacaaacaggaagggccaacagcagaggtatggcatgtacaagatgcagagctctgcctgaaaaagcctggtgtgttgtgagtctggcaggtgtttgaaggctgatgtggctggaggctagtgcctgtgaagcaggtggtggctgataagattggagaggcaagctgttatcctctttatgcatgcagaaggaattgacttcaggctgggcacagtggctcatgcctgtaatcccagcactttgggaggctgaggcgggcagatcacctgaagttaggagttcaagaccagcctggccaacatggtgaaaccctgtctctcctaaaaatacaaaattagccgggtgtggcggtgcacgcctcctataatctcaactactggggaggctcaggaagaagaatcgcttgaacctgagaggcacaggttgcagtgagctgagatcgcgccactgcactccatgctgggtgacagtgtgagaccctgtctcaaaaaaaaaaaaacaaaaaacaaaaggaattgacttcagccatttggagccatgaggatctgtgagtgagatactgtgtcatgttggaccatctcaaagacagcttctgaccccacagttctcaaccttgttcttacttatttttagagacagggtctcgctctgtctcctaggctggtatgcagtggtgccaccatggctcactgcagcctcacaaactcctggactcaagtgatcctcctgcttttgcttcccttgagtgttggcatctcatgggactccaggggcacatcaccaattacagatgataattttttttttttttgagacggagtcttgctctgtatcccaggctggagtgcagtggcgcgattttggctcactgcaagctccgcctcccaggttcacgtcattctcctgcctcagcctcctaagtagctgggactacaggcacccgccaccacgcctggctgattttttttttttttttttgcatttttagtagagacggggtttcactgtgttagccaggatggtctcggtctcctgacctcttgatccacctgcctcggcctcccaaagtgctggtattacaggtgtgagacaccacgcctggcctttttttttcttttttgagacagagtctcactctgtcacccaggctggagtgcagccgcgcaatcttggctcactgcaacctctgcctctcgggttcaagcgattctcatgcctcacccctccaagtctgggactacaggcgtgtgctactatgtccagttaatttttgtatttttagtagagatggggtttcaccatgttggccaggctggtcacgaactcctgacctcaagttatccgccaccctcagcctcccaaagtgctgggattacaggtgtcagccaccacacctggcctgttagtttttttgaggcagagtcttgctctatcacccagactggagtgcagtggcccattcttggctcactgcaacctctacctcctgggttcaagcgattctcatgccacagcatgagaagtgggattacagggattagtaggtgggattacaggtgtgagccaccacacccagccaggcccagataattttaaaatttatttttttatttatttagaaatggagtctcactatgttgccccgtctggtcttaaactcctggcctcaaggaatcctccctccttggcctcctaaagggctaggtgacaggcatgagtcacactgcgcccagccttgagcttttgtgctcgagatatagtccattcagaacctctggttggcacttcttatctggcacatgcagggcaccttggatctcttattatctttgagcactggtctgaacccacttgcttgccttctcccaggggctgccccgtgcaccccttgttcctagggtggggatggggttggatgcctggggttgcagaggggactagcagagggtgacccttttctctatgctattacttcagatcttggcttttgctttcttccaaatacacagcaatcttggcttccagcctaggtgggaaagggagaaagaaccgatttcctccagctcctctctgaaagtagcccaactggcactgtttaggaacaaggagttcctgagagtgttggcaccccacggtgttgatgtccggtagttccctgctgtgaaccctgtctctgccccacttcaatccaaggaccctgtggagggaattctaggcttcttcaaagcctctgcagtaccagctgcctccaaggcctaacatagtgaagtgatagggagacaggaccttgggggagtttggggataactgtgggagttcctgcaaggtgggtaagagtctggccatggcatcttctggtctattccacaaaaaaggtggatgcctctgagacctagctctgttatgttcattacagccctatcagtctcttctggatgtctgattcctagctgccaaacatccaggtgctagcagctgggggtggggtaggataagaaggggggtgtctacctcaaccttcctgcccaaaccattcattttaaagtactgtgaagaaggctggattagtgttaaattcaataaagttaacaaagcaaagtattgtagtgagtacacaataaatagttgctgcatgaggaatttcttgaaatgaattcaagatgagtcttgaaaaacgagtgggagtaagccgtgcacggaagcagaggtctagcagaggtctagcgccaagtcccagaggcctgagagggcaagccttggtgggggaaaaggcagaagttgtgactggctgcctctgagagtgcaagtagccatgcaaagttgggaaaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtgagtgcagcgcgcccccgtcccgggtacctccggttgaatctggtggcttgcaccgaccccctcccctgtccccagacggatctagatggttcttccctccatcccgtaccgacgactgttcccccttcccccaccccctccccggcacattgtccttccctcctttctttgaagaaagccgacccgcccctcactccgtcacgagggtgggtgactcagcgtcctccttccccgcggcgccagaagccagttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaacccagtctctactaaaaatacaaaaattagccaggtgtggtggtgcacgcctgtagtcccagctactggggaggctgaggcaagagaatcgcttgaacctggaggcagaggttgcagtgaactgagattgtgccactgcactttagcctgggcggcagagggagactccttctccaaaaaaaaaaagaaaagaaaagaaagaaagaaatacatggtagggatactactacaaaggcattcactagctttagatacagggttactgttgatccccgactttttttttttgtttgtttgtttgttttttgtttttgtttttaagacagcatttccctatgtcgcccaggctggagtgcagtggcatgatcttggttcattgcagcctccgcctcccaggccgaagtgatcatcccacctcagcctcctgagtagctgggatatgtaccatagataggtgcgtgccatcatgcccagctgatcttttttttttttggagacaggttcttgctctgttgatctggctggattgcagtggtgcgattatgtctcactgcaacctctgcctcttgggttcaagtgatactcctgcctcagcttcccaagtagctgggaatacaggtggtctgggaatacaggcacacaccaccatgcccggctaatttttgtagagacaggctttcactgttgttgcccaggctggtctccaactcctgggctcaatcgctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcctcccaaactgctatgattacaggtgcgagccactgcacccggccatcagcatgatgtttatagaaccagttattcatttattccacagatgtttatagaataatttctgtctgttacactgaggatacagcattgcacaagagagctggaggtggttagataattagatatgcataaataaaacgccagctgctgatcagtgctatgcaaaagaaggcggggtaaggagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctatggtcagctactggggaggctgaggcaggagaatcgcttgaacccaggaggcagagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcata

SEQ ID NO: 289 - DNA, 32872 bp, Homo sapiens; identical to SEQ ID NO: 288

SEQ ID NO: 290 - DNA, 32872 bp, Homo sapiens; identical to SEQ ID NO: 288

SEQ ID NO: 291 - DNA, 8012 bp, Homo sapiens
cagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtgagtgcagcgcgcccccgtcccgggtacctccggttgaatctggtggcttgcaccgaccccctcccctgtccccagacggatctagatggttcttccctccatcccgtaccgacgactgttcccccttcccccaccccctccccggcacattgtccttccctcctttctttgaagaaagccgacccgcccctcactccgtcacgagggtgggtgactcagcgtcctccttccccgcggcgccagaagccagttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaacccagtctctactaaaaatacaaaaattagccaggtgtggtggtgcacgcctgtagtcccagctactggggaggctgaggcaagagaatcgcttgaacctggaggcagaggttgcagtgaactgagattgtgccactgcactttagcctgggcggcagagggagactccttctccaaaaaaaaaaagaaaagaaaagaaagaaagaaatacatggtagggatactactacaaaggcattcactagctttagatacagggttactgttgatccccgactttttttttttgtttgtttgtttgttttttgtttttgtttttaagacagcatttccctatgtcgcccaggctggagtgcagtggcatgatcttggttcattgcagcctccgcctcccaggccgaagtgatcatcccacctcagcctcctgagtagctgggatatgtaccatagataggtgcgtgccatcatgcccagctgatcttttttttttttggagacaggttcttgctctgttgatctggctggattgcagtggtgcgattatgtctcactgcaacctctgcctcttgggttcaagtgatactcctgcctcagcttcccaagtagctgggaatacaggtggtctgggaatacaggcacacaccaccatgcccggctaatttttgtagagacaggctttcactgttgttgcccaggctggtctccaactcctgggctcaatcgctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcctcccaaactgctatgattacaggtgcgagccactgcacccggccatcagcatgatgtttatagaaccagttattcatttattccacagatgtttatagaataatttctgtctgttacactgaggatacagcattgcacaagagagctggaggtggttagataattagatatgcataaataaaacgccagctgctgatcagtgctatgcaaaagaaggcggggtaaggagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctatggtcagctactggggaggctgaggcaggagaatcgcttgaacccaggaggcagagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcata

SEQ ID NO: 292 - DNA, 7185 bp, Homo sapiens
agttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagtgggtatcctggggttcccaaggaaacagctagaaaggacttggccagaggaaaagtaggctagaacttttgtctggtttcctgctaactggctctgagttttcctagggcaggtagaggggagatttgttagtcttcagcctaaaatggatttgtccagtcgtctgggggctttctacttggctgtggaatcttgagcaggtcatttaacttctgggcttcagtgcccttatttgcaaaatatagatatttactaaaccagtggttttaaacttgtaaaacagtaggtttttttggggggggggaatcccaaatattgttttacgactcgatatagacacatgtttaaaaaggttcactttgggagtggggaacacaggggccacttctctgcactataaactttctgccttccaatatctttttttttttttgagatggagtctcactcttgtcacccaggctgcagtgcagtggaacgatctcagcttactgcagcctcctcccccagggttcaagcgattctcgtgcctcagcctcctgagtagctggtactacagccgtgtgccaccacacccagataatttttttatttttagtagagacaattttcaacatgttgaccggtctggttttgaactcgcctggcctgccttcccatatcttaaggcccttccttgctcacatctgtttcaatggaatgaattttgcccgggttcaaattcaagcttttgtaccaagtaatacataggaaacactcagtgacttgcatttgtgatttccttattttcccttaactcatagactgtctcatgattgcgtcttcctccgttgttttaggcatccgtgtcattctggaccttactcccaactaccggggtgagaactcgtggttctccactcaggttgacactgtggccaccaaggtgaaggtgagtgttggagctgatggctggtggaagtcagatgctggggctgggacagtcctttcacagcaagccctgtagacccagcctgactccagctgagggtccctttgctccttaggaccaaggaggaatgcctcctcctatagccaaaggataggccaatagcacacctgtttttcttgttccttttctgacctcttatttttcttatttccttgactctgaggatgagacagtgccaggaagggaccttctcagaagtcagtctggaagtttgatttttctttcttttgggagaggaagccctttctctgtgagaatcctgtcctgactggtttcccagttcttgtttgatgtgtttggaatagagcccagtctgaaattataagcactggggtactcctatgtgtctgggactctatgccaagtattttatagatgttttctaattctctgtataaccatacaaggtatataatttgccataggttcaaatgtgtacccagcaggctaggagtagggctttgaatgtcacctagctcctgatgtctgggtcctaggacactgacctgttcagaatgggtagaacaaaaatggaagcagatactgacactgctggtagctgtgattctaagatagaattctggactcccagcatttgggtaggaccccgggatcatccagtttaggccttgccagttactaggggaccctttaaaagttgctgatgagggaatgtttttggatggtttggcatgaggggcggtaccctcagatggaaatggagaccagaggagagagtacatggcccagagaaagggaagaaaaggagaatgggggtgaagttccacagtgtgtgcaggactgccaggattccattcagcagcactggcctcttttcaaatctaaactgccctggggctatgctttgaatttcaatctttcatccttggccttgctctgagcagttattgtactcacaccttccccaggcctcaggaaactgggagaggggggatcttgactgacattttagatcctgtctgctgctcactgattatgactgtggacgcgtctccctgcttctctgggtctgtttcttcatctctaaaataggtatgctaacattccaatgctaagtgttaaacgaagttatgtttatggacataccttttctctggggccttttctgtggctttcaaagttgaagctgtgtgatttgccagaggcaagaatgagaagtaaaatgctgtagcactaagaaaatgagtggaagggtagagctggaggggtccaaaggctaagcctttgtagtgcaggtggggaagacccaggcaaggcacaggactctccccagctcccggggaagtgtgtggtgggtgaggtttagtgtgggctggaattttctgagccttttcctgagaactgatgtctgtcctttattcttctgccccctataggatgctctggagttttggctgcaagctggcgtggatgggttccaggttcgggacatagagaatctgaaggtgagttccctttccacattagggacaaagcttgggcgagaacagagggactcagctagagcctcataatattctctggtccttgattctgcttttttctttctaggatgcatcctcattcttggctgagtggcaaaatatcaccaagggcttcagtgaagacaggtgggtgcaggagccattctgctgactcagctccaatgtgggaacccctcagtggagtgctaggcctaagaaggggggattcctagtctagagcattttctttacctttattctttctttagctttttttttttttttttttttttttttttttttttgagatggagttccgctctttttgcccaggctggggtgcgatggcgtgatcttggctcactgcaacctctgcctcctgggttcaagcgattctcctgcctcagcatcccaagtagctgggattacagacgcgggccaccacacctggctaattttgtatttttagtagagacggggtttctccatgttggtcaagccagtctcgaactcctgacctcaagtgatccacccgcctcagcctcccaaagtgttgggattacaggcgtgagccactgcgcctggccccattctttcttgtgctaaccttgaactcctccctcccctctgcaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtgtgagtaccatgctggtgggaaagggggcagatgggagaagaaagggttgttgggagacagaggcagaggtgggttatggggctcactggagtgtctctccctgtagttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatgatgattctggggatggcggcacatagacgtgagccttggggtgaaaacgcgtttgattcttagtcagtagctgagtggctatgtggctttgggcaaattattttacctttctgaattttggtcatcccttgtgttactgcatttcttgaagggtggttagtattaaatgagggcatgtttttaatggtaatgcctggtacctggcagatgtttgctatggtagccaccattcatttattcattcctttattctttggacagtgggtactgtgctaggctctgtgccctcaggagctcatagtttagtgagggagccagataaataagtggagaagtacatggcagtggctgggcacggtggctcatgcctgtaatcctagcactttgggagtccaaggtgggtggatcactggaggtaaggagttcgaaaccagcctagccaacagggtgaaacccagtctctactaaaaatacaaaaattagccaggtgtggtggtgcacgcctgtagtcccagctactggggaggctgaggcaagagaatcgcttgaacctggaggcagaggttgcagtgaactgagattgtgccactgcactttagcctgggcggcagagggagactccttctccaaaaaaaaaaagaaaagaaaagaaagaaagaaatacatggtagggatactactacaaaggcattcactagctttagatacagggttactgttgatccccgactttttttttttgtttgtttgtttgttttttgtttttgtttttaagacagcatttccctatgtcgcccaggctggagtgcagtggcatgatcttggttcattgcagcctccgcctcccaggccgaagtgatcatcccacctcagcctcctgagtagctgggatatgtaccatagataggtgcgtgccatcatgcccagctgatcttttttttttttggagacaggttcttgctctgttgatctggctggattgcagtggtgcgattatgtctcactgcaacctctgcctcttgggttcaagtgatactcctgcctcagcttcccaagtagctgggaatacaggtggtctgggaatacaggcacacaccaccatgcccggctaatttttgtagagacaggctttcactgttgttgcccaggctggtctccaactcctgggctcaatcgctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcctcccaaactgctatgattacaggtgcgagccactgcacccggccatcagcatgatgtttatagaaccagttattcatttattccacagatgtttatagaataatttctgtctgttacactgaggatacagcattgcacaagagagctggaggtggttagataattagatatgcataaataaaacgccagctgctgatcagtgctatgcaaaagaaggcggggtaaggagcctagagactaggggatgatggggcttgttttatagagagtagccataggagacctggtaagataaccaagcagatacctgagggaagtgagagagctggctggcagccatctgggagctcttggctgaggggcaacagtgtatgtgtgaggaccctgaggtgggagcctgcctcactcatccagtagaagttagccaggccgggtgtcgtggcttatgcctgtaatcccagcactttgggaggccaaggtgggtggatcacctgaggtcaagagttcgagaccagcctagccaacatggtgaaaccccgtctttactaaaaatacaaaaaaattagctgggtgtggtggtgcacacctatggtcagctactggggaggctgaggcaggagaatcgcttgaacccaggaggcagagattgcagtaagccaagatcgtgccattgcactccagcctgaacagagcgagactccgtctcaaaaaaaaaaaaaaaaaaaagttagccagacatgagttggggaggttatatattgatgaggatgtgaatgggaagagggatacgggacagtgggcccagggctttttttttgagacagggtctcactctgttgcccaggctggagtacagtggtggagtcatggctcactgcaagctcaaactcctgggttcaagtgatcctccctcctcagcctccccagtatctgggactatagggatgtaacactacacccagctaatttttaaaaattttgtagtagagatgagggctcattatgttgctgaggctggtttcaaatgcctgggctcaagcaatcctcttggccttgacctcccagactgctggaattacagatgtgagccaccatgcctgaccccaggcctttttaaagtcctattttctctgcttttcagcctatggaggctccagtcatgctgtgggatgagtccagcttccctgacatcccaggggctgtaagtgccaacatgactgtgaaggtaagagttctagatgggtagaaactgaccggtggagggtgggctgggcttgtagaagtctgtacccaggggagcccctcacacgcttctgctatgtttttatcattcttagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcata

SEQ ID NO: 293 - DNA, 70861 bp, Homo sapiens
ttcctgagaggttgcctttacttatatgcacagtcactcctttagcagaaaatattatggaggtgttaggatgagataaacctgacagcaaccagttccaagaccacacacagcagttttccccttgcctagccccttgagatgcattcttgatagcgagagcacaatggttcccctgagagcctccgtggcccttctgtgtgcctttatcaaccactccccaccatcaccacccttaggcagagagaggaagaagcaggggagatgtggctaattcttctttggaaacacagaaggctatgtcagatgcaatggaatatattgtgacataggattatttggagtattcagccatggggatctcttagaggtctcttatttaaggataggggacctctatggagggcatggttggcttatccaccttcagggtgggcaatgtagtttgaaaggtagcctcacttgtagcctgcctggtgggtgcttgggtgagttcaaagaccacggtgggcatcggtggttgaatctcatgcttgccaggcttcaaaggtgtgacagcattcttgataggtagtagtttcttggatggtgctgcaaaattgaaatggccttggtgttcctttccactcttgggtagagccgggtagagggctgctagagtccaaggaccttccacaactcggacaggaggtttcatggctatgtgcaaatctatctatctatctatcttcctcattcttacttccactctgagtatctgtgggatggaaaagacacagattcctcaaatgtcacttctccactctctgtcagtcatgtgtgaaattcaagttatctcttaaatgttagccactcccttaccctttcaggttctttcctccaagctctcccctctacctcaggctttgtgcaaactttattatggccctccaattcagcctggggctggggcttaagagtctactactgcatgaggctctagctcaccatggaagtcctcagaaagcagagactgacatttgcttaaagttcatgtattccatagccattaaattagtttagaaaaatgagggcttccctcaattaaaatgagggctttttaaagggcagagactttgtcttgtttgccactacatatacagtgctcagaagtgtttgtcacacagtaaatgctcaataaacaatttctgtccaacagaaaaaaaaattagatggtagatacttctaataatggagctaggagatcaagaccaatccttctaccaaagacaaattaaaaactggatgatatacaaaaacaagaaaacatcttaaaattatctatgcgtttacaatatacagagaaattgcatggccaaaatctagaagagtgtgagaatctaaagcccagaactcaggttttgttttctgcttagatttaccttttatttttattaattaatttttaaaagttttttagttgttataaatattcaaagctttttttttaacctgagtgtaattcgatctggaagaaacagctacaaacatgagcttccatttttttttttgtcagctttataggagaaagggaatttttattggatttgaatggaatttttagatcaattccatgacaatatctttataacttttctaattcatgaacatgattgctccatttatttgggcattctttctctcactaaagttttgtagtttttagtgatcaatcatatgccttcccttgtgaaggcttttttgattaaagtctattttttctgatatatttttctgatctaagggatatataccagaggctgtgaatctttggggttatcataggatagttaccgctcttttattattatactttaagttctagggtacatgtgcacaatgtgcaggtttgttacatatgtatacatgtgccatgttggtttgctgcacccatcaactcgtcatttacattaggtatttctcctaatgctatccctcccccatacccccaccccacgacaggctgtggtgtgtgatgttccctgccctgtatgcaagtgttctcattgttcaattccctcctatgagtgagaacatgcggtgtttggttttctgtccttgtgatggtttgctcagaatgacggtttccagcttcatccatgtccctacaaaggacatgaactcatccttttttgtggctgcataatattccatggtgtatatgtgctacattttcttaatccagtctatcactgatggacatttgggttggttccaagtctttgctattgtgaatagtgccgcaataaacaatacgtgtgcatgtgtctttatggtaacatgatttataatcctttgggtatatacccagtaatgggatcactgggtcaaatggtatttctagttctagatcctcgaggaatcgccacactgtcttccacaatggttgaactagtttacactcctaccaacagtgtaaaagtgttcctatttctccacatcctctccagcacctgttgtttcctgactttttaatgattgccattctaactggtgtgagatggtatctcattgtggttttgttttgcatttctcacatgatcagtgacgatgagcattttttcatgtgtctgttggctgcataaaggtcttcttttgagaagtgtctgttcatatcctttgcccactttctgatggggttgttcttgtaaatttgtttaagttctttgtagattccaggtattagccctttgttagatgggtagattgcaaaaattttctcccattctgtaggttacctgttcactccgatggcagtttgttttgctgtgcagaagctctttaattagatcccatttgtctattttggcttttgttgccattgcttttggtgttttagtcatgaagtccttgcccatgcctatgtcctgaatggtattgcctaggttttcttctagggtttttatggttttaggtctaacatttaagcctttactccatcttgaattaatttttgtataaggagtaaggaagagatccagtttcagctttctacatatggctagccagttttcccagcaccatttattaaatagggaatcctttccccatttcttgtttttgtcaggtttgtcaaagatcagatggttatagatgtgtggtgttatattctgagggctctgttctgttccattggtctatatctctgttttggtaccagtaccatgctgttttggttactgtagccttgtagtatagtttgaagtcaggtagcttgatgcctccagctttgttctttttgcttaggattgtcttggcaatgccttgtaagttggattcctaggtattttattctctttggagcaactgtgaatgggagttcactcatgatttggctgtttgtctgttattggtgtataggaatgcttgtgagttttgcacattgattttgtatcctgagattttgctgaagttgcttatcagcttaaggagattttgggctgagactatggggtgattttgtatcctgagactttgcagaagttgctgatcagcttaaggagactttgggctgagacgatggggttttctaaatatacaatcatgtcatctgcaaacagggacaatttgacttcctctcttcctaattgaataccctttatttctttctcttgcctgattgccctggccagaacttccaacactatgttgaataggagtggtgagaaagggcatccctgtcttgtgccagttttcaaagggaatgcttccagtttttacccattcagtatattggctgttggtttgtcataaatagctcttattattttgagatatgtcccatcaatagctagtttattgagagtttttagcatgaagggctgttgaatgttgtcaaaggccttttctgcatctattgagataatcacgtggtttttgtcattgattctgtttatgtgatggattacatttattgatttgcatatgttgaaccagccttgcatcccagggatgaagccaacttgatcttggtagattagctttttgatgtgctgctggattcggtttgccagtattttattgaggattttcacatcaatgttcatcagggatattggtctaaaattctctttttttgttgtgtctctgccaggctttggtatcaggatgatgctggcctcataaaatgagtgagggaggattccctctttttctattgattggaatagtttcagaagaaatagtaccagctcctctttgtatctctggtagaattcagctgtgaatccgtctggtcctggactttttttggttggtaggctcttaattattgcctcaatttcagaccctgttattggtctattcagggattcaacttctgaattcgggtgggtaacccgacctttctcactttagttttgggagggtgatctttgctggtttagtcgtgggagggtgtccaggaatttatccatttcttctagattttctagtttatttgcgtggagagtttatagtattctctgatggtagtttgtatttctgtgggatcagtggtgatatcccctttagcatttttttattgcatctaattgattcttctctattattcttgctagtggtctatcaattttatcttttcaaaaaaccagctcctggattgatttttttgaagggtttttttgtgtctctatctccttcagttctgctctgatcttagttatttcttgccttctgctattaaatttgtttgctcttgcttctctagtgcttttaattgtgatgttacagtgtcaattttagatctttcctgctttcccttgtgggcacctagtgcgataaatttccctctacacactgctttacatgtgtcccagagattctggtatgttatgtcttttttctcattggtttcaaagaccatctttatttctgccttcatttcgttatgtacccagtagtcattcaggagcaggttgttcagtttccatgtagttgagaggttttgagtgagtttcttaatcctgagatctaatttgattgcactgtggtctgagagacagtttgttgtgatttctgttcttttacatttgctgaggagtgctttacttccaactatgtggtcagttttggaatgagtgcaatgtggtgctgagaagaatgtatattctgttgatttggggtggacagttctgtagctgtctattaggtccgctgggtgcagagctgagtttaagtcctggatatccttgttaaccttctgtctcgttgatctgtctaatattgacagtggggtgttaaagtctcccattattattgtgttggagtctaagtctctttgtaggtcactaaggacttgctttatgaatctgggtgctcctgtattgggtgcatatatatttaggatagttagctcttgttgaattgatccctttaccattatgtaatggccttgtctcttttgatctttgttggtttaaagtctgttttatcagagactaggattgcaacccctgcttttttgctttccatttgcttggtagatcttcctccctccctttattttgagcctatgtgtgtgtctgcacttgagatggggctcctgaatacagcacactgatgggtcttgactctatccaatttgccagtctgtgtcttttaattggggcatttagcccatttacatttaaggttaatattcttatctgtgaatttaatgctgtcattatgatgttagctggttattttgcttgttagttgatgcagtttcttcctagctttgacggtctttacagtttggcatgtttttgcagtggctggtactggttgttcctttccatgtttagtgcttccttcaggagctcttttagggcaggcctggtggtgacaaaatctctcagcatttgcttgtctgtaaaggatgtgatttatttctctttcacttatgaagcttagtttggctggatatgaaattctgggttgaaaattcttttcttttctttaagaatgttgaatattggcccccactctcttctggcttgtaaagtttctgctgagagatccgctgttagtctgatgggcttccctttgtgggtaacccgacctttctctctggctgcccttaacattttttccttcatttcaacctttgtgaatctgacaattatgtgtcctggggttgctcttcttgaggagtacctttgtggtggtctctgtatttcctgaatttgaatgttggcctgccttgctaggttggggatgttctcctggataatatcctgaagagtgttttctaacttggttccattctccccgtcactttcaggtacaccaatcaaatgtagatttggtcttttcacgtagtcccatatttcttggaggctttgttcatttctttttactctacttctcttctcacttcatttcattaatttgatcttcaatcactgataccctttcttccacttgatcaaatcagctactgaagcttgtgcatgtgtcacgtagttctcatgccatggttttcagctccatcaggtcatttaaggtcttctctacactgtttattctagttagccattcgtcttttttgaaggtttttagcttccttgcaatgggttcgaacatcctcctttcgcttggagaagtttgttattaccgaccttctgaagcctacttctgtcagcttgtcaaagtcattctccatccagctttgttctgttgctggcaaggagctgcaatcctttggaggagaagaggcagtctggtttctccccatctttgtggttttatctacccttggtctttgatgatggtgatctacagatggggttttggttatggatgtcctttctgttgatgctattcctttctgtttgttagttttccttctaacaaacagtcaggtccctcagctgcaggtctattgggggagtttgctggaggtccactccagaccctgtttgcctgggtatcaccagcagaggctgcagaacagcaaatattgctgcctgattcttactctggaagctttgtctcagaggggcacctggctgtatgacctgtcagtcggcctctactgggcggtgtctcccagttaggatacacgggggtcagggacccacttgaggaagcagtctgtctgttctcagagctcaaacactgtgctgagagaaccactactctcttcagagctgtcagacagggacgttttagtctgcagaagtttctgctgccttttgttcagctatgccctgcccccagaggtggagtctacagaggcaggggcctccttgagctccggtgggctccacctaatttgagcgtcctggctgctttgtttacctactcaagcctcagcaatggcagacacccctcccctagccaggctgtggccttgcagttccatctggactgctgcgctagtggtgagcaaggctctgtgggcgtgggacctgctgaaccaggcagggatataatctcctggcatgctgtttgctaagaccgttggaaaagtgcagtattaaggctggcgtgtctcgattttcctggtacagtctgtcacggcttcccttgactaagaaagggaaatcccccgaccccttgcatttcccaggtgaggtgatgtcctgccctgcttctgcttgccctccctgggctgcacccactgtccaaccagtcccagtgagatgaaccaggtacctcagttggaaatgcagaaatcacccgtcttctgcgtcaatcacgctgggagctgcagaccggagctgtttctattcagtcatcttggaacagacctcaggatagttacctctcttgattaggttatgctatatgacaaaggttctgggataattactccaatgatttacattacattacattacatagacttcatcatagattacacagacttcatcatagcagactggagagatattctgttgttggctttgaagaagtaagctgccatgttgtgaggaccatgtggataggacttgagggtcacctctaggagctcagaccaaaaccctgctaacagccattgagaaaacagagatgacttcacttctacaactatgaggaacttttaattctgctaacaagcagtgagcctggaagaggaccacaaacctcaaataagattgtagccccaattgataccctgtaaagagtaagtaaaggaactgtctaacccatgtctgtgagataatacatttgtatagtgttaagctgctaggtttggagtaattttttaaaatacggcaataaaaaactaatataggctgggcagggtagctcacatctgtaattccagtgctttaggaggccaaggcaagccgactgcttgaggtcaggagtttgagatcagcctgggcaacatagtgagatgccatctctacctttttttttttttaattagccagtcataatggtttgtgcctgtggtcccagatactagggaggctaaggcaggaggattgtttgagcccaggagttcaaggttgcagtgaaccatgatcatgccactatactccagacttgggcgaaagagtgagaccttgcctctaaacaagcaaaacaaaaaactagtaaacacagcaatagaatctatccaaaaataaaggaaattaattaaatattttaaatgactactcagaagactgaggcaggagaatcgcttgaaactgggaggtggaggctgcagtgagctgagatcatgccactgcactccagcctgggcaacagagcaagactctgtctcaaaaaaaaaaaaaaagtctcagtaacctatgggataatatactaacaaacagctgtgtaactggaatcccagaaagcagtggtggagcagaggcagaaaaatatttgaagaaataaagactaaaattatgtccaatttgatgaaaattatactctgacagatctaagaatttcagcaaaccctaatcaagatagtctctctctccctctcacatgcacgcacacgcacgaagttaagccataatcaaactactaaaaaccaataataaaaggaataatcttaaaatgtagccagaggaaaaaagacacgttacaaacagaagaacaggggtaagaaaactgaaactttacataagaaactacatacgacagaagacaacaaaattgacttaaattgctgaaaaataccccctcacactagagagaggccttctggtggtagacatggcatcagtaggtgcagcagtacgtgcccatcctggaggtggcatggggcaacacatggcactccgtatttagcaaatgaggctccattctcctcaactttaatggatctgggctgtggttatggctgaggtcctgacttctgtctagtcttccttgttccttccctgattctaaacttggtcctgcaccttctagatatctctttgaggtacccaaatagctttccaatgccttttctttctgcttagatcaagaaaaactggtttctctaataggcaacctaagagctcttaaaaacagaaaatccttcatttattttctactcaccttttctcatcaccattttagcatagtagtgggtagggtcaagttaactgttactttttctaagccacctcttttatctaggtttatatagttcttcaattttactttcaaaacttctttcccagccatgtttcctcctcatctccatgttctatcactgcttggctggattattgttatgggctgaattatgtccccccaactccaatttcatatgtcagagtcctaaccctcagtgtgactgtatttggagacagggcacttcaggagtaattaaggttaaatgaagccataagggtggggccctaatccaacaggactggtgcccttatgagaagaggaagagagacccgagatcccactctcccaagcacacacacagaaaaggccatgtgaacacacagtgagaaggcagctgcattcaagctaagaagacagtgctcactagggctcctcaccaaatttgccagcaccttgatctgggatttctagcctccagaactgtgagaaaataaatttctgttgttcaagccacccagtctatggtattttgttatggcagccctagcttactaaggaacaactactgatataatcataaactagctgcaatcgtcagttagcttcagactttgtaacgtagccagtagagtgatcttaaattccatgtaatttgtaactcaagtaaccatgtaacttgaggtcgccctgcctcagacctgggtaaacttggcttaaacctccagtttcacagcatatgaaagaccattgccttctatttaatttattcaaatttctaaacttagtttttcatgatccctgtggattcattcctgcaaccctaagtgttgtatcagttccactcatctgccagctggtacatggaatatcaggagcttcaccattgtccataagaaattaaattaaattcatgattttgtgactgttccaactttaattaagtctccaggagttgcggaaggaaattatatcccacaccgcgcagtcttctgcctcctaattggtttccctttgacactgcattggcttccaaaacttactgtgtgatcatcctcacaaccctcaaagaaactctagcatcccttccccttactaagcctaattcacttcctcagccctttacacagaaatctaaccatgtcgcttccttgtgtgaatgaaagcgataatgccatctcctaactgccaatatgcagtgacttgactctggtttagcaattccaggaccgctgaagttttcttcctctagcctccaacatatatcacccacaaatgatacccataaagcaccttccccctaatgggcatggcagctactctgtcctggacctagatgcctggcccagtgatgtcaatgctatacttttgccttcttcctcactgctctttaaggaccagcccctcccctctctcaggccaccctccagagacatctttcggttatcttcagcccctctctaagtgccttgcacaaagtgtggactcagtggctgtatgatacatgaatatatgaagaagtaaacacccatgcttgaaatcttccaaggggcctcactgcttagaggatgaaatctaaaatctgaagcctgatgtacagagtcctccagaatctatgcccagcctatacttcccctggtccctcccccaaccccacccccaactttccagacaccctcagctcttgtcagggacatgaaaagctgcctctgtctcctggaagcaatgggtagggatgaagagacaggagtgggctaggcctctgactttacctgtgcgagtgctggaggtttcaaacaatttttctttttcagtctctctccgcctagaaggaagcagaccatccatgaaatgaaggggtctaaagaatcatggtctcttctaacgttcctcctccaggatcttcttcccccttccatcttgaaacttacaatcctatagcatttgcctgcaaggattcccaaatgtcattttcttctacagataaaaagattatgggcgaggcacggtggctcacacctgtaatgccagcactttgggaggctgaggcaggcggatcacctgaggcggggccaacatggtgaaaccccatctctactaaaaatacaaaaattagccaggcatgggccaggcagggtggctcacccctgtaatcccggcactttgggaggccgaggcgggcagatcacaaggtcaggagttcaagaccagcctgaccaatatggtgaaaccccacctctactaaaaatatttttaaaaaaaattagctgggcatggtggtgcctgtagttccagctactcgggaggctgaggcaggagaatcgcttgaacccaggaggcggaggttgcagtgagccgagatcgtgacactatactccagcctgggtgacagagcaagactccgtctcaaaaaaaaaaaaaaaaaaaaaaaaaaaaattagccaggcacagtggcaggcacctgtaatcccagctactcgggaggctgaggcaggagaatcacttgaacccaggaggtggaggctgcagtgagccgagatcatgccactgcatgccaccgcactccagcctgggcaatagactgagaccccatctcaaaaaaacgaacaaaaaaaatattatggcccagaaagaagcagttgttttcccagggtcacctagcaactaagggacaaagccagagctaaaacccagtcttcctggtttatgaacttgctctttgcacactgctatgccatttcatggaagatgggaaggtggaggcacttgttctggacaatattcaagccctgtcatctttcaactgctccacattgaatccatagtaataggcttgactaagctttagtgacagtccctatcctgaaaatattgtcttatttgggggaggtcaaaggggtgtgaggaactgcagactacatgagaagagagattcagattataaacgccatcttgccatgtgggattacgggaagagcgtaactcttatttttctcaatttcctataataatccatttattttggaaaaaattcatttaaaattatatatatacttaccagtgaaaacaaaatatggcaacaataaaaagcacagaaatgatatctgcaaggagccacatgaacacatagaactttggtgtctgaaaaacataaaccacagtgaaagaactttacagttagaagggattttggatcatacggtctaagtcccttgctctgctgccagggctggaggaggagaggaagaggggatagacaggccaaggaaccttgattgatgtggcattctcaaacacagacagtccctgcaagtgtcctaacagtcacccttatacatgcagggggctctagagggaatagaacacttcacacctttcatctcacctttcatctcccaagacagagggcagagggggtcccagagaagtcacacaacaagtctattctggacccaagaccacagtccaggttcttgacttctactgctgttttcaaggcatggcttctcaaacctggctgtgcagccaagtctcccggggcagcttttagtaatacaggtttctgggtctcactagacacctaaggaatgagaatctctgcatttttaacacattcccaggtgatgctgaagccatgtgtctgtaagccagcatttgggaaccattgttctaaagtatcacactttaattaagaatgctgaagtacaattaccccttacctacatgctcctcttctatgctccttgcccaaatcatctatttcccagagctctgtcttctgggtcctctcattgagtttgatgctccctttccacctcaattgtgccctctctaattccacttgatgctaatagggctggcacattttatcctttctcagaccactctccaccctatcccaaggtctttccttgagctgaataataaaattaataacactaatgatcataattaacaataagcaattaacaggagccaggcaggtattctaagcacttcaggggtatttacagatttaagcctcataatagccctactagtagaaaatcttaaccaacttccactgaactgaggctcttaatcccctctgggaaaaatattgactgagggctgctgtagttggctgattgctccaagaggcctaccagataagcagaatgttcacaaagaatcagttatccttgtttcccaaatggcttaagtcaactgtacttgttattgtaatagtgcaatgtaattagatgctgcttaaatttgtgagatctgagtgaaaaaagtatgtcattttcaaagaaactaagtcaaatgctttgaaaaactcaatgaggacaaaatagatcattaaagaatagacagcaattagattaggtgtaggtgaaacactacaagggtttgagggattataaagatctaggtagattgctcattcagattgattgtcctaatgactttaagttcctgttctgcttaaaacaaacagttagaaatcctagctagttcatctggatgtttaaatgagagaacatagaactcgatcagcagaaatatcctcaaagaaatgactgtcaaaaggtgaatgaatattttaaaataaaatttgtgaagtatgtatgtggcatactgtttataaaaatgaccacaaaattccttccaaacctatatgcaggcccctacacaacgtgacttagctgtgcctccctatcaagaggtgaagtctgtttctctcccaccctgaatctgaatttggccaggtgattttccttggccaatggaacatcagcaaacataacactgtgagaactttgaaaagtccatgtgctttggggcttgctctctcttgctgttgggaacccatctccactaggtgaacacactccagctagctgccttgaggatgagcgacgacacgaagagaaacttggtcattccaggtgcgcctctagacaaatgaacaaggcatcctagactatccagcccagctgacttggctcaaaccagagacaccacctagccatcagccagaattgagacatgataaatatttgtttaagacactaagttttaggtagtttttattaagcattaaaagctaactgataaagtgtatatcatttttaaatgattcctcactttaattttctcaattacgagaccaatgaccagaccagattatgttggacacaagtgtttctactgcactattattatccccaattttcaaacagaagaaacaaaaaagccaaaaaccacaaacacattaactagtatttccacattcacacagtaagtaatggagccaagatctgaatctaaatctcaatcagtctaactctggagtgtaggcttcctgttaagacctctgggacaccagcctcacctccctgaataaaatgacacatggcataggctgggaaccatgcattgggtcctttaaaaatgcctagactaggtgtggaaggaagattggttttcttacatatatccttttaaactttttgatttttgaatcacatggatttattcatttaaatattaaaatgaaaaaaacgcattcagaaatagcatcatttaagtaaatgtgtacctcccaaagggacaactttgagacattactgattcaggggataggattatggaggggtgtgctgctttctaaattatgcatttttgtaatgactggattttaaaatgttagaaaaacacatagtatatacatgaaggggagttatatggggacaggtgggtggaaaggctccacctgtgctgagtgacctgccatccaaagctcccttcagggtcatctccaggaagctgaccaagccaccatagtaagaagtcagcgatttctcctgtctaccagagggcctagatgcagttactggccctgtaagactgtgccttgactctggatcccttttcccctggtcctgaccctgaacaggtcagaagctcaggccagagggtggagatctggaggaggtgacttgaggccccttccctcttaggcttctctgacaaaggctttaactttcaaggccatttggagtttgggttattacttgggattggactcttaattctgaagtgaggctttttgatgactaaaagtgaacttctaaaagttatctaacagtgactggaaaagctacaggacctaagtgagatttcattcaggggcagagaaaggcctacatcacagaccaggtttaaagaatcaatgcagcgaaattaaactgttttctgttgtatgctattgtgtcccactcagtcaacctactctctgtacagataagaacaagttctgtagcagtaactggttagctagggctccctccacagatagtgataggatttggctgggatcgtaaaccaggtcttcaggttctcaagcttctggcagtaagcaacagaaggcctagaacatgcaactggacactggctaccctcttcaaaagccatttgttagggcacacagtttccactttggagtcaagtacgcttggttttctccccactctccatgccgttgtcaattgttgccatgcctctacaaaggtggggctacagtaacaaaactctgaagtcagacctcattctgaatcctgcctcatgaaaccacatgcaaagatatctttgagcttcagtttcctcatgaagatgataacagtggccaattcaaagggttaaatgacataacgcatgtcaagcacattgtaaggattcaataaatgtcaattattataacaacactaatttttgcctgaaaatcccagaaggatctgtgagaatggaaaataccacatctccaatattcatagaagtctgtactcttaagtggctgcccaggggatggcacagtgggcaacacagggctggggggcctgcactgctatcataccaagcctggaagaacaatctggacaaccagctcaccatgaagaagtgagggtgatcaagctgactcaggagcccaatgttgtctgtggtcactgagttaatcctggagcaccaggccagtgagaaaagccaaggctcattgacggtgtatacgttgatatggatgttagctgctttataatctctggaacaaaaacagaacccacaggggatttagatcaagtttcattctcatcatctaaaaggagaacagccaccatgtttgtgaaaggctgttgcctaaatcaccagaagcagctgatccagggacaattcatgatacgatgtgacagaatgggctcatagtacaataagataaaggattggatttagcacctctgctcctgtagcaacagtggtgtgctggtaaaccaaatgtcctaaggagaataataaaaaggaagaaagaaaacatattgaaaaaaaaaaaaaaaaaaagaatggggaaaaggaaaaaggaaaaccctattgtagcatatgcaaatttccatggtaaaaacactcctaccatagccaactgtaagctaccattggtagaaccaatttgcagagtttctgaatatttaataacaagctggtatgagctggctctggcatgctactatgtagcagcacctatatactcgcttctatcagagcacttatcaccccgtactcgaatgatctgctcatttatcagttctttacttgactctaagcaaactaaaagcagagactatgtcttatttgtctctggatactcaatacctagcataatgccaggctccacaaatattaattgaaaaaataaataaatgagtaccaatctggtgaacttattaaatttcaaatataaggaatttttgcaagtaatgaaaatagggggaaaacctaatttgtcccatggcactaaatgtcagtggatacttgtgaactgtttatagagacagggagaaaataagtggaggaacacctagtaattccagctaagttgtcattttcagggattcaatttctcagaaaacataccatgtaaatgccttcaaaaaattttttcaactctcaaatggtatggcatattggaaactgctctgtacaagcctgggtttgaatcccagttctgtcatatacgagcttagtaaattcttggcctcagtatagaaactgtaaaataataataatgcctccttaacagaggtgctagcaattagttatccaatatgttagaattgtctctgaaccaatccctgcagataaagataaattttaaaaataaaattaggaaaaaatagtaaaaagttacttatttttaccttttgaaaccaaaactcaaaaaccaatcacattccttgtttgtttaaattttaaattcaggagatacatgtgcaggtttaatacatggatatattgcatgatactgaggtttgaatctgctacccaaatagtgaacatagtaccccacaggtagttttccaaccctttcccctgtctctccctcctccattttggactccccattgtctatcatttccaactttatgtccatgtgtacccaatgtttagctcccacttataagtgagaacatgtggtatttgatcttctgtctctgcactaattcacttagaataatggcctccagcttcatctatgtgctgcaaaggacatgatttcattctttcttatggctgcatagtattccatggtgtatatgtgtcacattttctttatccagtccaccactgatgggcagttaggttgattccatgtctctgctattgtgaatagtgctgcaataaacatacaagtgcaggtatctttttagtagaacaatttattttcctttgggtagatgcccagtaatgggattgctgggtcaaatggtagttacatttttagttctttgagaaatctctaaactgctttccccaggggctgaactaatttacattcccaccaacagtgtctaagcatttccttctctctgcaaccttgtcaatatctgttttttttttttttttttttttttttttgactttttagtaatagccattctgactggtgtgagatggtatctcatcagggttttgatttgtatctctctgatgattagtgatgctgaggatgttttcatatgtttgttagttgcttgtatgtcttcttttgagaagtgtctgttcatatcctttacccactttcttaaacaagtggagtgacatatgtgttcatggattggaaattcaatgtagtaaagatgtcagttctccctcaaatagatctgtaagtttgatgcagcaaggtttttttgtacaattagcaagtggattataagattcatatggaaaagcacagccctacaataattaaaacaatctgaaaaaaaaatagtgtgagagggaatcactctatctgatgttaagacttattatatagctacagtaagcaagctagtgtggtattagaggagatatggacacataaatcagtggaacagaaccgaaaaccatacaatagatccatacaaatgtgacaaatgatttttgacaaagatgcaaaagcaattcaatggaagaaagtcttttcaaaaaataatgcaggagtaactagacagctacagtttctggagaaatcagtaaaaaataatccaaagatgtaaaaattcagccggagccagacatggcagctcatgcctataatcccaatgctttcggaggccaaggcaggaggatggcttgaggccaggagtttgagaccagcctggcaacacagtgagaccctgtctgtacaaaaaaattttaaaaaatagccaggtgtggtggcacatgcctatagtcctaactactgtggaggctgaggcagaaagatggcttgagcctagtagtttgagactacagtgaacaatgatcacatcactgcaccccaggctgggggacagagcgagactttgtctctattaaaaacaaaaaaaaaacaaaaaaaaaaacaaattgaagagatagaatgagatactaaaaaatgattaactaaaaaataaaaagagagggaaggagtgatcaaaaaaccccacaaggaatagaaaggacaaatagaaaaaaaatagcatgatggtaatgtaaacctaactagattaatatgtgaactaaatttttttttcaggttcactattgttaaccttttttcctccctttttttcttgttattaaagttctagggtacatgtgcacaacgtgcaggtttgttacatatgtatacatgtgccatgttggttttctgcacccatcaactcatcatttacattaggtatatctcctaatgctatccctgccccgtctccccaccccacaacaggccctggtgtgtgatgttccccatcctgtgtccaagtgttctcattggtgaactaaatattactggacctaacattccaattaaaagtccgagattatcctactagatataaaagaacagacaaaattttgtttataagagatgcactttaaagatgccaagtggttgaaagccaaaagatagaaaaagacttattaagcaaacacaaattataaggcggccagtgtggcaatattaatacaagaaaaagtaaactttagataagattaattaccttaaacaagggacatttcataatgaaggggccaattcaccaagatctaataatcctaagtgaaaatgcacccaataaaagagtttcaaaatacaagaaggaaacacacacacacacacacacacaaatcaacaatcgcaattacagttggatatattaacagttgggtatatattggtaactgacagatagcagtataaggaaccattcatttttctttgattggggaagttgctgccagaagaaagaaggaataagtcttgatcttgagaagtctgagaagtctccttctcaacaggataacctgatcttttgtaaaaagaataataatatttaccaggaagagtagccttatatgtaatgttcttaaaaggatgttcctgtttaagtctttctttattacatattttgtaaataaacatggaacagatttatgaggcatgggtccctggagcatgacacataaactagataactctctgggactatcaaatagagatgtttcatgactcaactgctccccttatgtgtgagttaaccctgcagaaactcacttggaggcctcatctattactctgggccacagagtacatgtccaataaataaagatacctgcacagccacaatcaatgtctctccttgctttgtttgagcctcttgattgcctgctgtatccttgaaattaatgataaatctcggcagtatgtaggttatctgatatgtgaatgtttgatctgcaatctaatcctttgtattagctcaacagaaaaaggaagaaaaaatgaatataaaattttcaaaaagcctatcaaccaacttgaactaattgatatttatagaatactacacccaacaactgaagagggcacataatcttcagggggacatgagaagctcaccaagataaaccatatagtgagccataaaataagtttagaatttaagccatagaatttaaaagggttgaaagtacacaggtttgttctctgatcacaataagcttaaattagaaatcaataactgaagtagctagaaaatcctcaaatgtttaaaaagttagcaatacacttccaaataatccatgagtctaatgagaaatgagaaaactttaaatattttaagttggataacaaagaaacaatatatcaacataatttgtgggagaaaattaaagcaatgcttacagtaaatttagagctttaaggctgggcgcaatggctcatgccagaggttgcagtgagccgagatcacgccactgcactacaaactgagtgacagagtgagaccctatctcaaaaaataaaaaacaaataagtttatagctttaaatgtttacattagaaagaagatctaaaacaggtcacctaattttctaccctaaaaaagccatctattagcaagaacagcaaattaaaactgaagtcagtgtgaaaattataaagagcagaaatcaatgaaataggaaagtaaaggtgcaataggaaaaagataacaaagccaaaattcagtgttttgaaatgattaaaattcataaacccctagcaagactgatcaagaaaaacagaaaaaataaaaacttccagtatcaaaatgcattagaactaaaggtggcaattgcacaacgatgtaaatgtactaagtgtcactgaattgttcactttaaaattttatgttaggctgggcgtggtggctcatgcctgtaatcccagcactttgggaggccgaggtgggtggatcacctgaggtcaggagtttgagaccagcctggccaacatgatgaaaccccgtctctactaacaatacaaaaattagctaggtgtggtggtgtgagcctgtaatcccagctacttgggaggctgaggcaggagaatcacttgaacctgggaggcagaggttgcagtgaaccgagatcacaccattgcactccagcctgggcaacaagagcgaaactccgtctcaaaaaaaaaaaaaaaaaattatgttatgtgaatttcacctcaatacaattttttatttaacatttttttaaaacattaaaaatagaccaataacaaggagtaataaaaagtaatacaaagtctaccgacaaagaaaagcccaggacatagtggcttcactgctgaattccaccaaacacttaaagaagaactaatatcaatccttctcaaactctttcaaaaaaaataaagtggagggaataattccaaactcattttactaggccagcattaccttgataccaaagcaagatacggacactacaagaaaagaaaattacaggccaatatcaccaatgaaatcctgagacataaaaatcccaacacaatactaacaaactgaattcaacagcaccataaaagaatcattcaccataatcaagtgggattcctccgtgatacaaggagggttcatcatatgcaaatcaataaatgtgacacactgcattaacagaatgaaacacaaaaaccatatgatcatctcaatagatatagaaaaagcgtttaacaaaattcaacaccctttcatgataaaaactctcaacagattatgtatagaaggaatataccaaaatacaataaaggccattcaggacatggccacaactaaaatcatactcaatggtgaacagtcgaaagcttttcctctaagatcaggaacaagacaaagatgccaaatctcaccacttctttttgacatagtactgtcttagccagagcaattaggcaagagaaagaaagaaaaggcatccaaataagaaagaagtcagattgtctctgcagatgacatgaccttttatatagaaaatcctaaagaatccacaaaaatactaaaactaatacattcagtttatcggttgcaaagttgcaggatacaaaatcaacatacaaaaaccagtagcatttctttctatgtactaacaactacctaactgatgaaagtaagaaaataatcccatttacaatagcaacaaaaatagaattcttaggaataaaactttaccaaggaggtgaaagatctgtacactaaaaactatgaaacactgatgaaaggggccgggtgcggtggctcacaccttataatcccagcactttggggggctgaggcgggtggatcacctgaggtcaggagtttgagaccagcctggctaacatggggaaacctggtctctactaaaaatataaaaaattagcagggtgcagtggtatgtgcctgtaatcccagctacttgggaggttgaagcaggagaatcacttgaacccaggaggcagaggttgcaatgggcagagattgtgccactgcactccagcctagatgacggagcaagactgcctcagaaaaaaaaaaaaaattggtgaaagaatttaaaaaaaacacaaataaatgaaaagttatgtgtttatggattgaaagacttaatattgttacaatgtcaaaattacccaaagcaatctacagattcaacataatccctctcaaacttccaatgtaatttttcacagaaataaaaaaaaaatccttaaatttgtatgaccactaatgatttctaaaagccaagacaatcttgtgcaaaaagaacaaggctggacacatcacattccctaatttcaaaatacattataaagatgtgataatcaaaacagcatggtaatggcataaaaacagacacataccagtggaacagaatagagagcccagatgtaaattcaaatcgttatagttaattgaatttcaacaaagatgccaagaacatacaatgaggaaaggataatctcttcaataaatggtgttgagaaattggatagccacatgcagaagaatgaaattaggcccttatctcataccacatacaaaaatcaaatcaaaatggattaaagacttaaatgtaagacctgaaactaaaactactagaagaaaatgggaaaagctccacaacattggtctctgggcaatgattttttggatatgaccccaaaagcacaggtaacaaaagcaaaaatagaccaacggaactacatcaaaccaaaaagtgtctgcacagcaaaggaaacaatcaacagagtgaagagaaaacctatgaaatgggagaaaatatttaatagcaaaaaaacaaataacccaatgaaaaaatgggctaaggacctgaagagatatttctcaaaagaagacacaaatagccaacaagcatatgaagaaaacactcaatatcactaatcatcagggaaatacaaattaaaaccacaaggagatatctcacacctctcaaaattttggctattacaaaaaagatgagagatagtaagtactggcaaggatgtggagaaaagggaactcttacacactgttggtgggaatgtaaattagtacagccattatggaaaacaaagtggaggttcctcaaaaaactaaaaatagaactaacatacatatgatccagaaatcccactactgagtatatatccaaaggaagtgaaatcaatatgtcaaagagatatctgtactcccatgttcattgcaacactattcacagtagccaagatatggaatcaacctaagtgtccatcaaacagatgaatgggtaaagaaaatgtaatatatacatacaaaggaatactattcagcctttaaaaagaaggaaattctgtcacttgtgaaaacatggttgagcatgggcgacattatggtaagtgaaataagccacgcaaagaaagacaaataccacatggtctcccttacgtgtggactctaaaaaagtcaaacttacagtggggtacggtggctcacacctataattccagcactttgggaggtggaggtgaggaaactgcttgagcaagaccacgtctctatgcagaatttaaaaattagccaagtgtgttggcatgtgcctgtagtcccagctacttgagaagctgaggtaagaggacagcttgagcccaggaagtagaggctgcagtgagccaagatcacgccactgcctttcagcctgggtgacaaaacaagaccctgtctttaaaaaaaaaaaaaaaaaaaaaaaaggcctggcacagtggctcacacctgtaatcccaacactttgggatgccgaggcgggtggatcacgaggtcaagagatcgagaccatcctggccaacatggtgaaaccccatctctactaaaaatacagaaaattagctgggcatggtggcgtgcacctgtagtctcagcctgaggcaggagaactgcttgaatccaagaggcggaggttgcagcgagccaagattgggcctttgcactccagcctggtgacagagcgagactctgtctcaaaaaaaaaataaataaataagtctaacttatagaaaaagagagtagaatgttggttaccaaaggctaatgttggttactgaaaagtagaatgttggttaccaaagggttgagggagagaggaaatgttgggtcaaaaggtataaagtttcagttagatagagggaaatgttttgagatctattgcacagcagggtaactacagtcaataataatgtatatttcaaaatagctgagagtaaattcaaatatcttaacatgaaaaagatatgatatatgttaattagcttgatttaatcattccatattgtgtaaatatattaaaacatcacattgtaccctataaatatatacagttatgatgtcgattaaaaataatataaatttttaaaatgtctttaaaacattaaaaaactttgtagtatcacaaataaaacagagggcaattctatactcatatacttttgattaaaacaatgcatttaaagcattctcagttaaaacagcaagaataatctcattaaaccttttaaccactccagcaggtaccactgttattctaatttacaaaggagaaaactgacaattagaaacttttccaaagagaccaaagtagctgatggctaggccaggtctagcaaacatataacttgacacataataatagctcaataaatggaagtcataattatttttcaactactagatcaatctcaggattaagagagaaggaaatcattctagagccattttctatttgaaaaaaaaagtagaagaaaatagaaatatgctcaaaatagaagagtagttgagtaaagaaaaatcttctgaatgggaattagagagtaaaacatatataattttccaacgctaaaagaaaaaaagacactattatatgatcaatccatagccagaaaggcagaaaaagcaggaacagaaacagatgcatgcaacagccttttactaaacccaaaggagactttggatatctattatctataatctattatagataggtagataatagatatctatatattatgtatctctaacctgttatctccctccctctgtccctccccaaggaagactttgtctctaaagcatttagaatcatataaaaaattaaccttaaatctaagacaaaggggatatggattaaattaagcatgtttaataatagttaagtttggaaaagttattttattcccaggtgcttttaattctgaaaatttgtctctaattgtatatttataaatacagtggttaataattttagtttcttctcatgctcagctatttttacattttttaaataatagttttgttatattcttaattatccgttccagaaatatggctatctggatcacaaagccatttacaaggtactgccatccatctggtaatggtaggaggaaataaacgttttgagttctgacttttcaacgtccaccttttatataagaacagaaatgccaagcatacaaaaaagtgtactgaatggtgaaagattagagtacacagcagaggctaaagtctatgttccagggacacagtcaacacttgataaatgtttgttggcacagggagggagggagggagggagggaggaaggggtaggaaaaagaaaggagattcaaaggagataaccacacacagaaattccgagatggaaaggggaagttaagaagtttaattagaatgtgtattttgtgtaagtaaggcaatatgtgccaagagaggtgtggtcaaacacttaccttaacccattagggaacaacttcttgtagtcaacatttattatactgatattgtttttagcaagggtttcaatggatactaaacggcccacatgctgaaaaccaggagccacggacctgacgtattgcctatcatgagctggcaaccaaaaaatctctaaggagaaacaagaagtccctcagtagataatcagctatccaggtacgaacagccccatagagaatggagggagctccattccagcacaggtagtattctacagagagtagagagagagagtctagtccttggtgaaagagtcaacatgggctagtattttctttgttttgttttgtttttgagatggagtctcgctctgtcgcccaggctggagtgcagtggcacaatcttggctcactgtaagctccgccacccgggttcataccattctcctgcctcagcctcccaagtagctgggactacaggcgcccgctaccacacccggctaattttttgtatttttattgtattttgtatttttagtagagatggtgttccaccgtattagccaggatggtctcgatctcctgacctcatgatccgcccgcctcggcctcccaagtgctgggattacaggcgtgagccaccgcgcccagccctgggctagtatcttctaatgaactcttataatggggctttcactagggctactctggagctgagttttctcatgacctctccatttaccagttaacatcaagtgtcaagggcctactgtgtacacaaagactcatacaagcaaagtagattagttgatagatatgggtgaatagtgagaatcaaaaacatctttctggttaatgatgttaaaaatcatctttgaggctgggtgtggtggctcatgcctgtattcttagcactttggaaggccgaggcaagaggatcccttgagcccaagagtttgagacaggcctgggcaacatagggaggccctgcttctattttatttaaaaaaaatcatctttgagaggagtcatttcctgccaacagagatgctattatgactcatctatgaaatacttccatttgtaaaaagacttataattgtttcactcacagcactcccatattctgagaatttatgggatttggaacaactgactgcccaaatgcagagttgcttctgaaaaacattacgagcaaatctctgctcaaataagaaccagctctcctttctatatcattcatcatgccaagtcttcaaagccttaatgttacccaggctctttctaatggatctatgttggtgtggtgcaggtcacattagatagttattacacatattcctctttaacagggtgctgacatttcatttggtttggaatagcaaacagcctcaatgattttccccactgagataaatttaactgggtcattcctagattaccacatgtagctgtataagtaacaatcttcatttccataggaagtaaaattacttaaggatcccagggtagatgtacaaggtaggtcaagttcaactactgtgctcctaggacatgctacccacctcccaacctatgtcataaatactgagatagacttaccagatgttgctcgattttagaggcaaggatcacgcttactacttggcggacaaatgtgtgtctgagaggatgttttggtggagggcgatgaagatcaaatatcacaaattttctttccttctctgcaagtgtcaataaatcagctagtgttggaattgactgatttcttgctctttctttatctgcctctgatagaggtttcatattgtaaaatggcctgagctagaaacaaatacatcaaaaaatacataaaagcactttccagttctcctactatgtagccacacatccagctctacctcagttgctccattatcattcaatccatcaggccctctgaagtactaatcctagaaaacaggtgacaaggagagaaataaaatgtaatcatcatcaataattacagtgtttggaatggtctcttctatatcctacaacctgttgtatttgcactgaaggtcatgttcttatcctgaccttcctttccagccttctctcccataagtcaagataatacatcccttttcagtcacgctggcttcctacatgggctcccgctattctagttttgtgtaataggaagaacacatgctttggcttcaactgaatttaataccagctctacccctcccttgacttccttgccatatccacttgttaaaatcctacccttcaaatgctatttccctcatgaagctttcctttaatcttcctgaactaaagagacttcaaggctggtgctgtgatcatgcctttaatcccagcaggctgaggcaaaagtatcacttgaggccaggagttcgaggccagcctgggcaacatagtgagacccttgtctctacaaaaaaattttaaaatagctgggtgtggagatacatgcctgtagtcctaactactaaggaggctaaggcagaaggattacttgagcccaggagtttgaggctgcaagtgagctatgattgtgccattgcactacagcctgggcaatagagtgaggccctgggcaatagagtgaggccctatctctaaaaaaatcaataaataaagagacttcaatggctttgaagcccaatggcccatttttatgcctctgtatgtctcattcatatatagctaatgtatgtaaaaatagctaagcatgagaagaaactaaaattattaacgactatatttataaatatacaattagagacaaattttcagaattagaatttggacatgtcttagtacattaaagttcaatcctggctcactatgcttcttgctatgcaaccttggtaataaaaccatttaaattctccaagtcatcattgcccaaattataaaatagaggagaggaagaataacctatatatttcttaggattattttgaagattaaatatgataaaaatatttacagggtctgggagtatgtctggtacatagatagaaaagtatacaattcacattagttccttcactctctgctgactctactggagtgtaactccctcttggtgggaactgtcatacattctttgaaacgcacagcatttcacctaacacatgggagaacacacatatgtttgctacattaaatttaatagatggcaactttgataatcacttgccattttttagatcatttgagtgaaggcagtgataaaaggctacctcccaggagaaggaagtagcagaaggaagaagtcacattttcttaagactcaagtaatctctctttttctctacacaactttatcttcattctctttcatacctctcctatttcttcttcttcttcctttgacctaaataagctgcctttttaaacatttttctcaggaaagaaacaatcacattgcacagtatctccggaaaattgctaggccagaaggcagatcattgctaggccagaaggcagatctaaaccatggtttagatctgattgaaagctacaactaatggttttcttaattctcaggacaatagaaatatgcttcagaattcaagattttgttagctactaccagacctaaaccaactggttcacttaactattaaaccttcttgtgagaaaaattgttaaaagaatttatgggaaagaccaacacaagaccaaaaattcaaaatagcaaagatggtaaatatttaatcaatataagagtttaaaactagactccagtaaactttaaatagtattatgggggtaggcctaacagctgaagtacattgtgcctctttagacttaatcagaaaaataaactggaatggataaatgcctgtttagactatattcaacatgtgattgaatgttttcaaaaagccacaggaagtaacaagctagaaatgaaaataaatttctggtcctccagatgaaacatctggttcctcaaataaaaataagattaaaaggtcctctgttctctgtgcctctgtgtagacatattacaaaaagaaaggttattggaagaaccaatgtataatattggttaagaaatagaaagacaagtccgggcatggtggctcacgcctgtaatcccagcactttggaaggccgagacgggcgaatcacctgaggtcaggagttcgagaccagcctgaccaacatggagaaaccctgtctctactaaaaatacaaaatttagccggctgtggtggcacatgcctgtaatcccagctacttgggaggctgaggcaggagaatcgcttgaaccgggaggcagaggttgcggtgagccaagatcgcaccattgtactccagcctggacaacaagagtgaaactccgtctcaaaaaaaaaaaaaaaaaaaagaaaagaaagaaagaaatagaaggacaattaaacctgtccaatgatgccacatcaaggaaacattccactgaatagacgattctgataagaactaactgtaactacatgtgaacaacaatacaattttcttttctttttttttttttttgagacggagtcctgttctgtcgcccaggctggagtgcagtggtgcaatctcagctcacttcaacctccgcctcccaggttcaagtgattctcctgtctcagcctcccaagtagctgggattacaggcatgcacgatgacgcccagctcattgttgtatttttactagagacagggtttcaccacgttggccaggctgatctcgaactcctgaccttgtgatccacctgtctcggcctcccaagtgctgggattgcaggcgtgagccaccatgcccggccaacaatacaattttcttgttgatatgggcaccaccacatctaccattaattgcattactataaaaaaatcagatcaccagagtactacaaccacttaagtagtgggagtatctaacaatcctgtctttttccatgtcccaatataaaactattactttgagaccattgtcagaagaacatctctttcttctctatggcactttccctgtacatttatttatttatttttaatttttatttttcttgagttttgttcttgttgcccaggctggagtacaatggcacagtctcagctcactacaacctccacctcccaggttcaagcaattctcctgcctcagcctcccgagtagctgggattacaggcacccaccaacatgcccggctaattttttttttttttttttttagtagagacggtgtcaccatgttagctaggctggtctcgaactcatgacctctcccctataaatttaaatattagaggctgggcaaggtggttcacagctgtaatcccagcactttgggaggccaaggctggcagatcacaaggtcaagagatcgagaccatcctggccaacatggtgaaaccctgtctctactaaaaatacaaaaaattagctgggcgtggtggtgtgtgcctgtagtcccagctactcgagaggctgaggcaggagaatcgcttgaagccgggaagcagaggttgcagtgagccgagatcacgccactgcactccagcctggcaacagaccgagactccatctcaaaaaaaaaaaaaaaaaaaattagcaagctactttgcaaaaagaaccacaagaagaaatgtactacagacaaattgtttttcgaagcctcagaaggttctatcgcacattatcaaattacagctcatatgaacgttactatattgattcaaaaaataaccaaatagacttctggtttctggttccacatgtaaggagcttggaagctgtcactccatcctaacaacaagtaaaaagttgaacagaatgaaaaatcaacaactcttattggatctgtaatagaggtgaggacacagggcaaactgctgcccagaaaattggagacacaggtgaaaggagatgaatcatagcttaccagaatgagcctaacaaatggaaaccactaaggaaaccagtgctcgggtaggaaaacttgaaccatcactgacaaattcctggaggattagtgtggacaagtctgagagttaaaaactcaaggggacaccttgagatacgtgattatgttgcttatttgaaatctttctacgttttttgatgtaggcatttattgctataaacttcactcttaacactgcttttgctatatcccataaggtttggtatgttgtgtttctattttcattcatttcaaaaattttttaaatttccttaagttcctcattaacccactgatcattcagaagcacgttgtttaatttccatatatttgtacagtttttaaaaagtataacatcttatttgtaaaaagcttaaatttgacataaaattttataaacacagtattatctgatttttacattttctcttttatttgagccaataaaatttatttttttaacttttattttagattcagtgagtacatgtgccggtttgttacctgggtatattgcatgatgctgagatttgaagtatgaatgaactcatcactcaggtactaagctcagtacctaatagttagtttttcaaccctggcccccttcctccttcagtagtcccaattttctattgttgccatctttatgttcatgtatatctaatatttagctcccacttataagtgagaacatgcagtatttggttttctgagcctgtattaattcacttaggataatggcctccagctgcatccatgttgctgcaaaagacaggatttcactcttttttataagtgcatagtattttgtggtgtatatacttgtacagttttgaaagttcctctcattgatatctagtgttattccattgtggtcagaaaagatacttaatatgatttcaattattttaaatttgttgagatttgttttgtggccttacacatggtctgtcctggagaatgttccatgtgctgatgaagagaatgtgtattccatagctattttatgaagtattctgtaattgtctgttaggtccatttggtccaagtacagtttcaatccaatgttgatcttttgtctagatgatctgttcaatgcccatagtaggatgttaaagtcaccaacatttactgtgttggaatctttctccccctttaaatctaataatatttgctttatatgtctgggtgctttagtgttgagtgcatgtatatttataattgttacatcttcttggtgaattgatcactttattatttcataatgaccttctttgtctttctatggttttggaactaaactctgttttatctgatgtaaatatagctattcctgcttgcttttggtttctgtttgcatggaatatctatcccttcactttctgtctgtatgtgtctttacaggcaaagtgagttttttgtaggcagcatatagttgagtcatttcctttattcattcaggcagtctgtatcattcaagtgactaattggtttacattcaaggttattataataggggatgacttactgtagtcattttgttaattgtattatgtttgttttgtatattctttgtttcttcttgtttttcatttcagtctgatggtcttctgtagtataaaaggtttgatttttttttctctctctcctttgcctatctgctctattgatgagttttatgcttttccatgttttcataatggtgattatcacctttttgcttccagatgcagggatcccttgaatatttcttatagggctagtctagcggttttgcattccccagtttttgcttgtctgggaaagacttcctccctcatttctgaagaatagatttactgagtcaaatattcttggctggcaatatttcttctttcagtactttgaatacctcattctactctctcctggtctggatagtttcagctgtcagtctaatgagaattcctttatatgtgacttgatgcttttctcttgctctttttagaattatttgtctttgacttttgacaatttgataaaatatgccttggtgaggaccttttgggattgaatctatttgggaacctttgagcttcttagatctatatgtccacccctctccccagatttgggaagttttaaactattgtttcattaaatagtgtttctatggctttccaactctttccctcaggaacatctacaatatgaaaatttgtttgcttaatagtgtcctttattgtaggctttctttattctttttcattctcatttctttttttctcctctgggtaattttcaaatgatacatcaagctcagagattcttctgctgaaacaagtctcttgttgaagctctgtactatattgttttattttggtacttgaattattcagctgcaagggtgtccatttgggtttttttgtttgtttgttttttttttgttttttttttttttttgagacagagtcttgctttgtagcccaggctggagtgcagtagtgtgatcttgactcactgcaacctccccctcccgggttcaagcattctcctgtctcagccttccaagtagctgggactacaggcacatgccaccacacctggctaatttctgtgttttttagtagagacagggtttcagtatattggtcaggctggtctccaactcctgacctcaggtgatccagccgcctcggcctcccaaagtgctaggattacaggcatgagccaccacatccggctggttcttttttactgtatctatgtttttgttgaatttatcattgacataatgaattgttttcctaattttgttgaattgtctatttttttgtatctcatggagtttccttaaggtaattattttgaattccttttccagtaattcatttatttccttttcgttcaggtcttttactagagttattatgttcctttggtggtgtcatatttccttgctttttcatttcttgtgcccctgtgctaatgtctatgcatctggtggaataatcacctcttctaaactttctagagtggcttttctagagaaagattttcacctgcagttgggtcttagtgcactagttgagaagggtgtggtgactttgttcctgggtaggtgcagtggtatagtctctgtgcagcttctttggctgcattcagcgtcagcaaaaactgtgggcatctcagtggcttaggggtgtggaaatttgttgtcgcaacagcagaggtgtatgttgttaatgtccttggtccacaaatgcttttggtgttctccaattcttgttttccctacaatgaggagacttcactgaggggatccctcttggtgtcaggtctgacacggcctacaatcaactgccatggtgctggattccaggtgcaaatgtttacattggcagagtcctaggatcagagtctcacaaacctatttgccctctctgtgaacctttcactctctgtggcagagttggacataggttgcccacaccatcagactccaaccccttagcagcttgagtccaggaagttaggctgtagctgtgactccactcttgctaggcagggaacagccctggactgactctaaggaagaaggtatgttctggaggtttgagcctagggcacagggtatggctataatttgggagcttgagccaacagggctcagtggcagcttgggtgccttgggatgaggcaccatgtagtggcaacactagactctaagatggtaggattcagcagtatctcagactctgtgaggccaagtgcagcagccaagtaccccagtatggctgttgtttgggtcctggggggcaagaagcagcaccatgtgactccattccttagggatggcactatctcagcagcttagactctagggagctagtccagctccagggaagcagggtactacaattgtttggcctgtagggtcgggtatctctcctcagacactggtttgtttccctgggatgaagggtactatgttagctcagccatggaacgtgcagttgctcagctcagccaaaacattgattctccaagggttgatgtgccactctactcaggccttgggggcctgactgttctgagcagcccaggcaccatttccctgccacacagggctctgacaaagtactttttccttgagagggcagtgcacagtttcaactcaggaccccagtggcagggcatagccaagtctgaaagaggtagatggagctgttctgccaaagcaccgtatccccaggaaagggcacacagctccatctctagcccaagggtacagggggaggggtaggtgaaacagttctatctgctgcttggctccacagagaaaggtgtaacagttgcttggcctggggatgttaggccactctgttggggtggttccccagtagtttagcataagggatgaaggggtgctgtggctactcacctctggagcaagatgtgagtagttccaagatggcattgcgcagtagccatgtaggccacggggcaggcacagctggctccttctctgaggggaacacagttgtatggcctctaggtagctaccccagctgggcttagggcctgtgaggactgcaggggaccccaataggggtccaagctgttgctgggggctgctgggatcctcttgcctaccttttcaccatagagagaagttcctcctggttcctggctgatctcagctgggggatgaggtggcagggtcctgttgtttccttccattctctatgtgggtctcctgagtttctgtgctcaccagggtttctgttactcctctgatgtactctggtgctgtcctttattttcattaaaatatgtttttttatttattgttttggctgtctttgtggaagggatgagtgctagtattttctagttgaatatcttgctgtcatttctcctttgagtgggttctgtcatcctgcctgttccttcattaatgtgataaataaaacttgtactcatgccaactatgtatctgcatgaaaattatatttttatcatttctataattatactttcacaaaaggatataacaaagttccacggaagtgttggttgggctaaagaaacaggaattcagtttagcttccagtatcaactcccagaatgtctgtatctattcttattttgttataagattaactacttgattttcacaataatctcaagattaataaatacattaataaataatgaccaattcaccaccatgatcaatcaataatcatacccaaccaataaagaatcatcagaataatctttactaatttcttcactatggaaaaaactacccaaatctccaaatcttttaaatcacatgataacaccatttcaactaccttctaaccatacagcatgaaagcaaagaaagctccacgatcaaacctaaagataaagtctccagacaaccatatttgaaccccaggtttcaggatgctcttcagtagccattgaagtaggataactaaatgctacaagcaaagcacctaaacaccctaaacatgctaaaacagagctattaatgctaaaaaaatgcctaccaaaagtcactgcaataacagatccaaccctatcacttacaactaacccaaacattcaaaactggagacagttttgaagaaatgtttgaaaaccaaaaataaggccaggcacagtggctcacatctgtaatcccagcactttggggggctgaggcaggtggatcacctgaggttaggagttcgaggccagcctggtcaacatggtgaaaccctctattaaaaacacaaaaaattagctggtcatggtggcgggcgcctgtagtcccagctattcaggaggctgaaggaggagaactgcttgaactcaggaggcggaggcttcagtgtgccgagatcatgccactgcactccagcctgggtgacagtgaaactccgtttcaaaacaaataaaaataaggctgggtgcggtggctcacacttgtaatcccagtactttgggaggccaaggtgggcagatcacaaggtcaggagttcaagaccagcctggccaatatggtgaaaccccatctctactaaaaatacaaaaaaattagctgggcatggtggcgcgtagctataatcccaattactcgagaggctgaggcaggagaattgctcgaattggaacccgggaggcagaggttgcagtgagccgagatcacaccaccgcattccaccctgggctacagagcgagactctgtctcaaaaataaataaataaatataaaaaaagaaaactaaaaataaggatgctatttaataagttattaagtattaaatgtttctgaatgtacttagaattatgaaaaaaattaaattcatggttcccacatggtagctaaccatgactgctgacatgagaaacaactgttgtctttcagcaataaggaccactaagttccaataacgaccaagaaaaagcatccattaattaaaattcatcaactctactgttccatcaaacatctcagcctgatgaaactttggctcaattttaggagtaagtttaattctgtaaatcctaataagacttttatcagccttatattatacatcagatacaataataggcttttcatctagaacacacctttgccaaaatattaactatagctaactaattcaatatatacatcctaatggagcacctctagtttttatgtgtctatatatgagacatattgcagacgctacatatactcagaaacctagaatatcagagtaatcacattattttcatatatggaaatagcatggatagactatgtactcctatgaggacaaatattctgagtaactacagtaataacaaatccactttcagctatttcttatatcaatactaattaatacaatgaatctgaagtggagtctcagtagatgatacagtttggatatgtgtctcctcctaatcttatgttgaaatgtgacctccaatgttggaagtgaggcctagtgagaggcatttgggtcatgggggcagatcccttatgaatgatttggtggcctccccttagtaatgagtgaattctcattctattagttcaagcaagagctggttgttgaaaagagcctggtacctccttctctctttcttgctccctctctcgccatatgacatgccttgctcccccttcatcttctgccatgagtaaaagcttcctcaccagaagccgagcagatgctggtatcatgcttgtagagcatgtagaaccatgagtcaaataaacctcttttctttttaaattacccagtctcaggtattcctttatagcaaaacaaaatggacaaacacagtaggtaagtccatctgtacataattcttcacttttccctatttttacatgaaacatgatcaaacggccctcaggattaacatcaaacataaataaaattccattccaccagtacacaatcaaaaatcccttttcttttcctaattacactactaccgtataagtgagctattaccacagctgaccctcacaccttgctatctctgctgtcacatgtgctagcaatatggatgcatgctatctatcttgttgagatgtttattttcaaaatcaaagtctcaaatgagtatagctgattggtcagaacctaggtcacatgaattcctagtcataaaataagctagaaaacgtaggttgttttgttttctttaatctatcttgagaaagtaggcttgacctttatcaaatgcaattctgactttttacccacttaaaaacactcaaggataattctaaactctttaacttgttatgtaagcattgccataatctccgatcaacatgttttccagattattctcccaatctatcgctcatctacttcctacccctcttccttcctctcttctttcctctatccctccctccctctcctacacacacacacacacacacacacacacacacacacacacaccctgttgctccaggataatctctgaaacacatcatcattactgcccttgcttccccttggtaatgatcttccctcagctcaaatggtagctgtgcataaagtattccccaacttcttccagaggaaccattcatacttgcctcaaaattacactgtacactgcacagcacgtgctttatactgtaccacatccattattagtctatacatctccttccagaatctcccatctacattcctcagtctgagttagaagttgttcttgtgtgctcctgaagcaacctgaaattaactcgttttgctcttatcacaatgtacagtaactgtctgtttcttatactagcctgtgaattccattaaggctggatgtgtgtttattcaccattatattccatgtgccttgtaccattaggtgctcaataaatatttgttgaatggcaagcagaaaaaatcaaaaatatatgtcctagtctgcctcatctaggaaaatgttatgtacatgttagccatactgtaaaagcttatgaaatatttgggtaaaaagaaattacaagataagggtaagtttacaagtttgtcttcagactttctagtgaatgtagaaagcagcaattagactcacttcattactgaaaaagccctcctgccaatactatagtcctgctaccaaactgggatgaaatcgtgtggatacttgcctatcttcatctatggcctttattttcaggagcagcacatgatctcttacaaaaattcaatgcaggtttgtggaacttgggaatgtgtcttacctctggttttacaaaccatttgcctgcattcagagtcgataggaaatcccagttgaagaaggcagggttctcgcaggcagattctggctgaacttccccaatattggttgttcttttcaggtcaaagtcatgcatgaggaaaggcacatgatcataactgaggcagaggtagaaaagaagggcaggggtagataggctgaatttagctaccttggtagacaggctccccagacagtccttcaaggtcacaagtgtcactagggctccttactccctctcaaatcttagaaaagggctacatatcagtcatttacactttgatgtcaatatttttctgctctagggatcaatctttcatgatatataatcacattagtgatcgtgaaagactagcttctctattcaggggctttctggcattaggaaaacagcaggcacagtagtggcctgaaaataaagtgaatggaggtagggatgatgcaaggtcctcaggttccaggaccatactaagcaggtgtccacacagttttcctgtattattctgatcctttcccagctaggcactgcactgagtatttctttttgtttgtttgcttggtttttgtttttgtttttttgagacggagtcttgctctgtcacccagactggagtgcagtggcatgatctcggctcaccacaactgtgatcacacaagtgattcttctgcctcagcctcccgagtagctgagactacaggcatgcaccacaacacctggcttatttttgtattttttagtagagacaggattttgtcatgttggccaggctggtctcgaactcctggcctcaagtgatccgcccacctcagcctcccaaagtgctgggattataggcatgagccaccgtgcccagcctacactgaatatttctggtcctagactttccacatcagatagtatcataaggtaagttccttgttcttctatctgcaatttgctttggagaatctctgattttatgaaactatctctccctttctcattaaaatatctatgaagagaacatctataatgaggaagataaggcttagaacttactcttctgctataagccactagaaaactggacaaaataaaggaaataactattttcagttaatggacaaaaggatgcacaatattactacaatctctgagaaaagcaaaaaaaaaaaaaatgacataagcaattccatcgcccaggcttctttcctgcaggtgaatactgaatttcagtacagggtgggggaacctaaaagggacctagctgtcttgctgaaatgagaagaaagagattagagtaaggggggagccaagacagctagaatttatgggctagagtcccataaaggatagagttatgcaaaaacaaacacacagttccaagaaaatatgcaaaagtccataagtgtatggctaaatatcaatctgtatgtgtacagagtaaaactatgaagcttggcaagaacaacttctaagaaaagaaaatattaccagacagttctaagacaatcggagcttgcacaggggtatgaatcattcaagttccatccagcgagagaggagagtcttcagtaattacataggctttctttagagactccagaagatcacaccttagaaaaggggataattggccaggcgcggtggctcacgcctgtaatcccaacactttggtgggcggatcatgaggtcgagatcaagaccatcctggccaacatagtgaaaccccgtctctactaaaaatacaaaaattagccaggcatggtggtacacgcctgtagtcccagctactcaagtggctgaggcaggagaatgcttgaacctgggaggcggaggttgcagttagacaaaatcgcgccattggactccagcctgggcaacaagagtgaaactccatctcagaaaaaaaaatggtcgggggaggggggggaataatttagaactacaatggccttagagccactttagatcctctaaaaaagagcttaaaaacaagcttcaaaagaaaagaccaaactagtctggaagtaacaactatctgctagaaaatgaccaaccttaaaggatacaagatatagcacccaacaatgtaaaactacaagtccagcatataatcaaaacttactagagatataaacaagcaggaaaatgtgaccatatggaagaggaattactcaacagggacaaactcaaaagtgaaagagatgacagaattcatagacaagggtgttaaacagtgtagaacaaaattataaaggtgtaaacaaggtatgtaaaggaaaacatgaacataatgaagatacacatacaaggtataaaaaacggaaatttagagataagatataataactgaaatgaaaatttcattgcatgaaatttaaaacagatcagatattgcagatcatgcaaagaacaatgaatttaaagatgcagcattagaatctatccagatgaaagcatagaaagaagactgaaacaaaaaagaatgaggcatcagtgacctgtaaggcaatgatcaagcagtattatatatatgtaaatggagtcctaaaaaagaagggaggtgcagaaaaaaacatttcaaaaagtaaaactaaaaattttttcaaaatctgatgaagatttgaactgaatgctgaattctttcctggctaaaagtctccaaactaatgtcttcaaattctctttccatttttctcacttagactcaatgaaattactactatatttttcctgcaggcatatcttgtgatacataaactacaggcaagaaaaatatgtcagattgccactgcctgcttccacgttaactgaagatgctttgggcctaacatctttttttttttttggaaacagaatcttactctgtcacccaggctggagtgtagcggtgccatctcagttcactgcaacctccgcctcccaggttcaagtgattctcctgcctcagcctcccgagtagctgggattacaggtgcccaccaccacgcccagctaatttttctatttttagtagagatggggtttcaccatgttggccaggctggtctcgaactcctgacctcaggtgatctccctgcctcggcctcccaaaatgctgggattacaggcttgagccaccacgcccagccaaatctaacatctagacacctcaactgactgccctccagactaaggaaaccgatttatagatttctccaaacattacatttgtttttcttccatttgaaagctcatttgcaatactaactcctgaaacgagacacagctgtttaatgggactgggctattcccagaaatagaagactggtttacggggatcctttgccactcagctattaactcagttttcccaccaactcagcttttagtgtgtgaaacctctagggaagcttcagatggggatgttggagctcagaaacctacacccaaattgtggtatgctgacatgctgaaataaagaaggctgttaggcataatggtttaagctctttggcccaggcagttctgaataattaaattgtattagatttccttttggcaaaacaagtggtatctgcgcaatagctaataccacttgttgtgaatagaaaaaatttccaaataagctaaatagttatgagaggtgtgtaccacagattccccttaaatgatctctttagctggcttcctaagggaatgggaaactggttttagttccccttacaaactcttattattgtcatcttgctcttctttctattcacaacagacaatgaggactagtaacaaaagaactgacacttttgtcatgcagaatcagaaccctatacctggcactcaagaacatttacaggctactacaaagcagtttcattcctcaaatcctaattatggtacccttgacccctgtcagcaggaaatcagccaaagcagtcatggcccaattcctccttaatgatcacacttcaggactgagggataaagaagataagggggtactgaagccatcctcacagggttaacaagaattctggacagaaatatagctctaattaagtattaatcaggcttcattttgaaccacttccttgtaatggaaaatcatttgacattgaccatttgcatccccagtgtatctatagataggatttctgacattagaatcacaaggcttttgtttaagaattgcttaagatgtttttcagatcccatattccggtaaaacagctgatatgaaccagtttgaggacccccacagaggaacagaatcagcatgagaatatagtttcttcatctccctgtcccttgactttaccctgtactctttgaccaatcaacgatctgcacacttcagcccactccaaaaccattaaaaactctagccccaaactcctcagggagatggatttgaggtttcctcctatttcctcatttgatgactctatcactaaatctttctctgctgcaaaaaaaaaaaaaaaaaaaaaaaggagctggggctaggggtgggcatatgtggaggagaatacagataagcatccagaagatttcttatcaaaacataagacagaaaactaggaaataacaatttttacatgcttgaagaaaacaactgtcaacttagaattctatatgcagcaaaaatattcttcaaaaatgaagggaaaattaaaatatttcatacaaacaaaaagcagaataattcatttccagcatacctttactgtaaaaaagattaaaataattattagacaaaaaggaaattgatacaatttgaaacttggatctacacaaaagaatagtgccagaaatgataaatacgtgagtaaatatagaaacttttttctcattttttaaaaacagaattaactgtttaaagcaaaaagtaatagcaatgtataatgaggttcgtgatagcaccaggtcatactatgagagagatgaaatgttagtgtactgataaaagacatatgctttacacaaaaatgtataatactcaaagggagaaataagttaaagatcatattgtaaactctagcacaacgactgaaaaaaaagaaaagaggtatagctaataatccaacagtagagatgaagttctaaaaaatgctccattagtccaaaaggaggcaggaaaggagaaaacaacaaaatgatagtgcacttgccatgggtctaaaatttaaaggggtgccaaaaactaataagcaagataaatactattttaatacaatatttaaaagacaaaaccaatgcaaaaatccactataaacaaaatattaaattttaaatgaagataagatagtattactgatttttccttttgtctcaggttctcatatggcttggcatgacacatcttcattaaaatttttgacattttgttcatcatggatgctaaagggtaggcaataccaacagaaactagttatcacacacatacttgttatgtgtgacatttacatttatttcccttaaaaagttaggcggagactgcattagtagagagggagtaagagcaataggcacaaacaagcttattgggatctttcaatctaactcagcttccatggacttccagtgactgttggcaagatttctcctattggtccacacgaggaggtcaacatttcttcaggatctgtgtgtttctgcaatccccagaaaacttaattcagtgttctccagagaggtgtatggctggctgggcttttatgctaaaaattttataagaggactgggaataatagcagccaaaaattttgcgtagatcttctcagaatctcccataggctttcactcagatgcaaataacttgtttacattacttgctttttagatttaaaaaatgtctctgccttttcaaatgtttctcaaaaatatattcaaatgaaggttttttcatataaacgtgtttcacatttaagaacaacatagctgcaattttataaagtgggatgagcactatcaaattcactttggggtgaacttggggtagggatcaaacatcctttacaactatattatcacaaatctcaaaaattccaacactttaaaggcaagaagggaagaaggagccagcaaaagaagtcacataggaaacagccaggtaggaagaaaatcaggagagtatggtattctaatagccaaataaagaaagtctttcaaaaatgaaggacttctcaaatgctgagagagtaagatgaaaatgaaaatttactatgatgtttaagaagtttgaggtccctgataacttagtaagagctctgagaagtggtgtagaagaagcctgattgggataggctcaaaaaggattaaaagttatccaaaacaaaggggagaactgagagaaggcaaagaaaggcaatgttggagttcaagacactcaccctaaaatatgacggcaggagaccagaatatgccaccccaatatatacctctttggcatattgattattttgagctggttattttgagaaactgcagacacaggagaagctctgaaaagttgcccttttgtaaaggaaatttatatttataaaggaaattttcattagtaaaagtatctgtaccaataagagagctgctctgaaatcattttattatcaacagacttatatctgtttaataagacaacctttattcaccacacattttcttccctcttcttaccacaatttgtctctgcccccgcacacccctattcctttctatagctcaggaaactatacaagcttcaatcatctggccttttccttgagtttcaaatttttgtgggactcccatgtgcacataggtaattaaaattatttttctcctgttaatctgtcttatgtcaatttaatttgtagactagccaaagaacctagaagggtagaccaataaaaccttttgatcctctagagcagtacagaccactctttggaggaatgctgcttaaaagaaagtgaagacatggagcataaactggagcagtatatagggcctagaaaagttttaaaatgtcagaatggatcatcttctgattttagaatcactttatctatatcttttcttaagaaagctaacgcaattcttttctttaaattctattttgagaggattgtagattcacatgggtttgtaagaaatacagagagatcctatatacccttagcccatttcccctaatagtaacatcttgcataactatactatactatcacaacaaggaaactgacactgataaaatctgtgacctcattcagatttcattcgttttacatgaacttatttgtatatttagttctatatttagtttacatgaacttatttgtatattttgttaattttatcacatgtgcagacatatcaccaccaccatagtcaagatacagaaaagtaaatatacaagaagagttttgtgttaccttttaaagtgggagccacttctctgcctccttcacccctggaaaccactgatttttctccatccctttaattttgtcatttgaatgtgatcttcaaatggaatcatacagtatataaccttttgagactggctttattcactcaaagtaactcccatgaggtccatccaaatagcagcatgtttcaatagttcattcatttttattgctgggtaatattccacagtatggatgaatacagtttatttaatcattaaacctcttaaaggacatttgggttgtttctagatttgggctattacaaataaaacagctatgaaaattaatgtgaagtttttctctatatgaacattgtcttcttttctgtggaataaatgcccaggagtacaatttctggggtgtatggtaagtatataatgtgccacataatgacaattcagtcaacaacggacctcatatatgacagtggccccataagattataatggagctgaaaatttcctatcacctagtgacttcgtagccgtaatattgtagcacaatacattactcgtatgtttatggtgacacttctgtaaacaaacctgtacagccaatcatataaaagtatagcacatacaactacagataatacataatacctgaggatgacaataaacaactgttactggtttatatatttactacactacactttttattgttattttagagtatatacattctattatatatttaaaaaattaaatgtaaaacagcctcaggtagtccttcaggaggtattctagaaggcattgttttcataggagatgaccgctccatgcatgttatccctgcagacactgcagtgggacaagatgtgaaggtagaagacagtgatatgaacgatcctgaccctgtgtaagcctaggctaatgtgtgtgcttgtttcttagtttctaacaaaaaagttaaaaaaaaattaaaatagaaaacagcttagagaataaggttataaagaaagaaaatatttttgtacagctgtacaatgtagttgtgcttacactaagtgttatcacaagagtcaaaaagttacaataagctggagttaatttattattgaagaaaatttttttatgaatttggtgcaatctaagtgaacagtgtttataaagtcttcagtagtgtacataatgtcctaggccttcccattcacttaccactcactcactgactcacccagagcaacttccagtcctgcaagctccattcatggtaaatgccctatacaggtgtaccatgttttatcttttatattgttatttttaccgtacttttcctatgtttggatatatttagatacagaaatacctaccattgttctgcaattgcctacagtattcagtacagtaacatgctgtacaggcttgcagccgaagagtaacaggtcataccatatagcccaggtgtgtagtaggctatgccatctaggtttgtgtaagttcactctatgatattcacacagtgataaaattgcctaacaacgcatttctcagaacgtatgctcatcattaagtgagatatgactgtatttagttttttaagtaactgccagacttacttggagtggctatacaattttatgtttccaccaggaacatatgagtgactcaatttgtctgccagcatttactgttcttgctattttttaacttagccataccgatagatgagtagtattagttttaatttgcattttcctaaaggttaatgcagttgaacatcttctcatgtacttatttgctatctgtatattctcttcagtgacatatctacacatgtatttcgtccattttctaattggattgtttggtttgtatttgtttttgttttcattttactgttgagttttgaaagtttatatatcctagacacaagtcttttgccagacatgtgttttacaaatattgtctcccagtctgacacttgtcttttcattctcctcatagggtcttagagcaaaagcttttcagaatgaattccctggaattttctccttcccccatctctgcttggtaaaatggtatttttccttcgaggctcaacccaaacacaactttgagcacacaaattttttttcttttttttcccacacaacaggaagtgaccttttcctccactgaggttccattacacttatttttctctggaaggctcttgccacaaatggccttattctgtagttatctgtaaacatcccatgtctccttcactagctggaacatcttttaggtatgactacatcttattcatttgcatttcccaagcactcagaagaaggcctggaatacagcaaatgctcaaggaatgttaaataaattgctaaggtagtacatagagtgaagtggtaagcacggtttgcaatggggccatatgtgaatcatgtgtgaagactatatctagtgtgtctgatttgtaaccctgtcattgaaaacatggagatgcagaggtgcggtttgtgagatgtggttcatttgtgtagtacatgcatatatgccatatgaacacaggaacaactccccagggcttgctgtctctacaacctcaggccaggctggttctcttgcatggcattgaacttataccctcctcccctcaccccagttccctgctttcttaccttaagtgtatatcagtctccaatccatgggctccatgttcaacagctttctcaaaggacatcatggtattctcaggccccaactgtagaagaaaaggacatcaggccctaagcctcagagtctctcctcccagcattccttttgtggtaggggtagagcccagtaggattttggggagcagagcttggctccctgagatctcctttcaaaacctgtataccctccgtccaagctgattctgggactctgctcatctgagacaatgtcactgggcacagtaaagagaaatggactgggagttaggtggcctggattcaagtccagcctttacaatgaactctttattcttgccatcttaatgcaatcactttttctctccaggggcttccatggttctcttttcttctcttgaccacataccccacacatacttattttcacccatgttcatcatgctcagacctaccatgggtgcacctctatgtccaaagatggttggcttgggccccaaattctccttctcctgaatgcagggagaataaatccccagtggcatcaaatagagacctaaaaggataagaagaaagggtaatccaacaggcacttgtagacctgaaaaatttgaaaggaaggggaagtgggggaaaaagagataaagagggatggaaaatcatcccaagcaaagcagcagtctgagtaaacccacagtccatgggtttcattgactgtgtactggctaatttactttctatttctgtgacatttccacttacttccagggatttggatataaaagtatagaactgtacaaatatagggcattattattaaggcaactttactggaactggaaattgacagagggctcaactgtacaggggacagatggggaagaaaaggaaggagaagggatgtcaaggagcagcttctcaggaggaggaggagcttggctgattctaagaaagccccagagcctgtaaagatcatcctaaaacatctgtatatttaaggcagtacagtatagtggaaagggcactaattggcagaaatctgggtttaaagccaagttctgccacttcctaattgtgtgactaaggacaacttaacctctctgaatcttcattttcttctgtaaaatggggctgtcctgctgcttatatcaaccttataggttgttatgacagtgttgactcataatagttactctataaatattaatcatttgcttccccctctttccttccctccctctccctctagtacatacacacacattcacatacagagcctgtacacaatgcctgcgataaccagccattccccaagacttactattttagacctctgggaattttacccatttgtacattttcaagttaccacctttgctttagtgactttcaaatctcagtctccagctctaacctcttaaccttgtgattacattacattgcttgagtctttttttctcagaatgtgtcatcctgtatcttctcattctaactaaaatttagaaagtgaaaaagaaaagagttcattattgtcccctttaagcccttgccccagaaatactttctaaaatttaccctccacacacaagcatatatatataaacacacaatggcagcactatctatgcagtctttctcttgcctgcatacccccacaggtcagaaagcaaatacctcttacttaaaaaggaggaaaaaggagacccagagagaagaaggtcctattggtttatccatagagtggtgaaagatacttccattctcaaaacagtttagtgtacagatccagttcttttgattccattacactgggacaaacaatgaagaggaaaccagtgacagagacagacatttaaccttctgctgtaagtcctcaggtatgacatggtctcacaggggactgctttgagttacttggatgtaagcagaaatctctggacctagtattagttgaaactactaatatttgccgggcgcagtggctcacgcctgtaatcccagcactttgggaggctgaggcaggcggatcacgaggttaagagattgagaccatcctggccaacatggtaaaaccccatctctattaaaaatacaaccaggcgtggtggtgcatgcctgtaatcccagctacttgggaggctgaggctggagaatcgcttgaacccaggaggcggaggttgtagtgagccgagattgtgccactgcactccagcctggcaatggagcaagactctgtctcaaaaaacacaaacaaacaaacaaacaaaaaaagaaactactaatatttgaatataaatggaaagaactgtgacttgtaccagcactttggtcaagtaaaattaaaacagcctctactgcgtcacccaccatccatcttcagacagtcaatgtataataatgtagagaaagatcttatttttccaaaaaaagaatccctctttagaagaaggtctgtttggccacagaaatactatgacaggccattggccactataacagggtagtgagtgaaagcacaggagcatgcctgagtaacaagctaaatgaatttcaacgaggcataggggtggctagttcccaagcttctgttttcctgagtggagtatgcaagctaaagccagagctgaagaaataggcagggttctgccctatgtgacataccttctctttccaaacatgccacgtagaaggccacaggccagaaaaggataaccatcacagttatgctgaccaggtgcacgtagggagcaaagatctgtgagaaagccaaaagtcaggctggatacatctagacagctagtgctggagctataggatgatgcttacctgcattgacagcccagctaccagccacctttctttccagaatttgcatataatgaacattaaaatgacacacagaagaatcactagcagaatcaggatctagggaaacagaaaaaaaatctcctgacttcaagcactaggcttggatcagaactgtcctcaggaattatatgtgtgtcttcacaatgtcagggaccttatctgcttcctcattcttttaccataataatgtagagaaagatcttgtttttcctgcaaatccccagtattagatggaactaatcattcaccttctttgcttctaagtctttgctgtacagcatggctggaaaaaattacacagctaatttaccattactaatttactatctccagcctcagctgggtcctcaacattgcttggtatctcttactcagattcaacagttgccattaaattcttcaccatttctttagtcctcaattgtatactcaatacaattataagtaaataatactctgtaattgccttttcaacgtccgttttccccaacagactataagcttcatgaagtcaaggttaatattggtattttttatgattacatcctcagtgtcctgcagaatgcctggcacatagtaagcatccaataagtatttattaaacagatgaaaaaacctgcctgccagaacactgtatacttcatagagaaagaacattgagaccaagaagacctaattttcctaacttcctccctttcaaatgtatagttttcctacatccgtgctgccctctagacagtacttagctctcctttccataatctctacatctaaaataactgaatccataattaagtctttcacaactctttgctgacttcaatgataaattctaccaaacatttaaggaagaaatatttccaatctttaacaaactctttcagagaatagaaaaagagagaatactttataacatcttaagagtgcaacaaaacattatacccaaatttaacaaggacattattacaagaacagaaaatacatacatagatgaaaaagttttaaacaacctattaggaaaaactaaatgcatcacaacacaaaagttgaattgccagagtcataagaatcacagatcttacccaacaccaaacttcactatggatttaaaggatacaggcaatcatagagaacagataaaagattttccagtggcaggctgggagcagcggctcccatctatgatcccagcactttgggaggctgaggagggtggatcacctgaggccaggagttcgagataagcctggccaatatggtgaaaccccatctctactaaaaatacaaaaattagccaggtgtggttgcacacaactgtagttccagctactcgggaggctgaagtgggagaatcgcttgaacccgggaggcagaagttgcagtgagctgagattgcaccactgcactccagcctgagcaacggagtgagactctgcctcaaaaaaaaaaaaaaatttttttttgagtgaatatgatcacgtcaaatgcagttactcatatagggtctttcctctcccgtattagtatacattctgtttttggacttaaaatgtaaggtgtgttttgagcaaaatatgaagaaacattgcttcacaggcgtcattttggttttttatggagcatcattattttatattccattaattatataactctagccagtcaatatcttttaacacatgaacctatatattccaggtttgtttacaataaaaccaacctaaatatatctaggtatatcctgctagaaatttttgcagataagcagctgacaaatacatttcgtgtgtttaccaggaggtcaggttattagcatgtttacaaggagtttgggttgatgccatttgcttctctctgggcatctgtaggtagaaggggaaggggttctaggcctcgtgctaatgcttttcttcctaaatttattctgagtacaataaaatgaaactccaagccccacaaaatctcccttgccaataaaatcagtctctcctcacaagtctgataagcctggtccttcctggtttgaagacctgaagactcaaccaaggtagttaacttccaagggaatgccaactcttaacaatcaccctgcacttttcattgccttcagactctgtgaactagatcccagaatgcctcagaagatgaaggcttagaaaacaagattttactaacaaatattggcaaaaatcctgtagaatatgtgtgggaatgaattctaagggtgctagacaaggaaaagagaacataattttagaccagactaaatttattgatatgggtgcacttaccagagattctggatttaatatcctagaattcaggtattaagcagttcaaagaggttctgattgtttggttatctgaagcctaggctcattggtagcctatgctcaatgaaattgggatgccagtaatttcttagtataatatagaagaaataataaaagatttattaagaaaaggtgctggaacggtatcacctatgatcagctaacctactccctatatcgtgttctctgggaggtctcagaagacgctggtgaggaaagtgtcagcatccttgaaaagcactgtggtggccatcctgtatgcctgaaaaaaggtgagagatgctgccactcaaacagtcttcctgatttcaaaggggatgatgtgcttctgctgtggcagaggccaagtagcagtacttaactggcacaggcaacataagcatagtttttataatagacactaacctggaatggtaatcagaatgttttcagggattcttggtattggttaatttatcatggtgtcccaactccaaaacagatgttggatatcaataaggcctatttgttcaattttcaaatctatattctttccctagaaaaaatctcatggcttcaagctccatctattctaataactctaaatttatatttccagttcatacttctcatttgaataagaggatattgataaggcttggacctgtgttccctccaaatcttatgttgaaatgtgaccaccaatactggaggtgggcatagtgggaggtgtttggatcatggggacagctccctcatgaatggcttagtgctgtccttgcagtaatgagtgggttctcattctgtgagttcacatgagatctggttgtttaaaagggcctggcacctcctccttctctctcttgctccctttcttgctatgtgatatgctggctccccacttgccttccaccgtgattgtatgcttcctgaggccctcaccaggaccagatgccagtgctatacttcctttacagcctgcagaaccatgagacaaaatagacctcttttctttataaattacccaatctcaggtattcctttattagcaatgcaaattgactgatttaagacttaaggggaccactcaagagtttgaaatgtttctggatttggggaaatacaagaaatacaagaaatggtatcaacactatgcctgatgttctcactcatatttgggaggtaaaaaagttgatctcatggaagtagagaatagagtgatagttaccaagggctggaaagggtgggtcagagtgggagaaatgaagaggggttggttaatgagaacataccattagataaagagtaagttctaatgtttgacagtacagtaaggtgactacagttagcaataatttataatataaaatagcttcaaaatagttcaaaaaatagtttcaaaacagctagaagagttgaaatgttcctaacatgaagaaatgataaatgcttgagatgatggatatcctaaattccctgatttgagcattatgcattgtaggcatatatcaaaatcatcacatggatcccacaaatatgtctaattactatgtatcaatttttaaaaaccatgcccaaaaaagtctataaaaaagcaagaggctgtcactggagctgctcaagcccatgggagaacaaaacaaggatgctatattggaaatatgctgcatgcctgcagatggtggggcaaagctgactgtcctctggggaccagatatagaccctgtgaaagaaatcatgctggtgttattttaaagatatccaaacccaagacggggtaaaaaggacttcaaaaaagaaatttcagggggctacaggaagacaggcattgactccaccaagagagttatagtcaaggttctcagtaggatttctgaaaacacacatagaaaacgtccacgggaaaacaagcaactgtacatttacctagaaatgaacccctgattccctttctcccctctccttgtgagactgtgctcgtttctccatctcctcttcccctggaccccactcaggcggaaaagaggtagaaggaccaccatgccctctctgccgctatgggcttcaggcttggataaggcccaaataggggaggggaaacattttaaggttaataaagttggagcttaggttattacagtgaactgaaatttttaatcactgaaatgagagtattcttgtgactgaaaagtactgggaaattaatggaatgagtgcctaagattttactggaatgggaagaacagggctacagattgagtttaataggaagtagtgagaacaaataagagtttgggttcagctcgggttcagctccctccataaatcagttgcaacgttagaaatttaattatttcagttaatatggtgtaagtaaatctcttctctccaaggagaacagtaacagagagggtaaccccatacacaaaactgagtaccaaggagcatgttcaggcctggtctaaggttcagtcctggtctaaggtttcctatgtggactcagatgtcctaccttatgacacaagtgcaggtatagttcaatcctttcccaaagcaacaaaaatccaagtaactgcaaaagcaaagaagaaaaagagagttattttgaaatcaccaagttgccacccaaagcactgttcctatagctccaaattccgttcacagtctagcagtacactcatttcttgctatacctgtactttatttagcctctgggagttttccatgttgtttgcctgaaaaagctccctctccctatgccactgactcttcaaagccagttcaaatctcacctcctatttataactttcacccgcaacctcaggaagaattctgtgttatctcctctaagatttcataacaattaccacactgatactcagttgagttcctgcccatttcttttccctgtgaggaaccttattcatggtattacttggactcacttgtaagagaagaaaggtcaggaggcagcccttccaaggactcttgttttggggaaccagggctgttgttacaattgtcaaccactgttgttaacactggtatagattcaacaaatcttggattttaatctaaatctagccagtcaccaagtcagtgtaaagacagaaattgagaactggagtcctcagatgcctaggatattaatgataatttgatgtgtaaggcacttacctctttatcaaaataatttcatgtgtatttcatttgttctttacttaaccctatattataccattttattaaatattatcattcttatttgaaaaaaaaatgaaactgaggtcagaagagttacatgccttgaccaaggttacatagtacctaaagatagaactagaaatagaatccaggtccccctcctttttcactattgttgccattgcatgtatccaaaaagaagtagggtagagtagaaagtttgttaaaatatattgctttattggacacctgaattcattcccaccttagaacctaactataccatttcatgtttattgtgcataaaagtggtacaattcagtggtcagagtttgccctacagcacatccttcatctacattttccccatgtaaaaaaaaaaaaaaagtttctaattggtctctctgcccatagccaccctccaaaccacaacatcaagaataattttcctaaaatagaaaactgatttatatcaaatgtcttagcctttctttccaggccttccaaaatctcacaaacctcttttcagccatgtttcctttttttttttttttttttttttttttgagacagagtctcgctctgtcgtccaggctggagtgcagtgtggctcgatctcggctcagtgcaagctccgcctcccaggttcacgccattctcctgcctcagcctcccgagtagctgggactatgggcgcccgccaccacgcctggctaatttttttttatatttttagtagagacggggtttatcattttttattgtgtctatttgattcttctctcttttcttctttattagtcttgctagcggtctatcaattttgttgatcttttcaaaaaaccagctcctttttgaagggttttttgtgtctctatctccttcagttctgctctgatcttagttatttcttgccttctgctagcttttgaatgtgtttgctcttgcttctctagttcttttaattgtgatgttaggatgtcaattttagatctttcctgctttctcttgtggacatttagtgctataaatttccctctacacactgctttaaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgacagacagtttgttatcatttctgttcttttacatttgctgaggagtgctttacttctaaccatgttagccaggatggtctcgatctcctgaccttatgatccacccgcctcggcctcccaaagtgctgggattacaggcatgagccacagtgcctggccccccattattcttcattatgccctacatactaacagaactgaccgttccctctcagcaagacagcctatatttttctgtcttgcttagtcatgaagctccctcagtccacaatgttcttcctcattaccatatctatatgtccaaatctaacattcctttaagatcccactacagtgacaaggaatagttataacttatatctcacatctacctctatgaagtgcactgcatgaaaacagaaattgcttagcttttattgatcttcgtatactcagcacttctcacaacgttctgctcatataatgattaataagttttgttgaaagaaaaagttcatgcaaatagcaacatatttgggggctaggttcttctgtatcagacaagaattcaatagagaaaggaatggtgaaatcagagaaagttatctgccctatgtataaatgggcactgcaaaactctgtctaaagttatcctcccatttccagacttttctcttacctggcataaatttctcacactaagtgacactactatgttaggcaacagaagcaaggtcacactattgccaaaggcttttgctaaaatgtactttgcatctgggctaggtgactagcatttgtacattagaacaaatttaacaagtaagcaaatttttttaagacccagaaagactgattttcagaagatgggacatgagatgagtaaagatactgctgctgtgaagctatgggtatctaaaatgacaatattgagggaaccataggatagggtatgaaacaaggaaatagaaaaaggatgttgttacactttcaaagggccaaactggcaagacacatcctctaacagaacaggctttccttccacgtccttccacgtcctattccttgtgcctaaaattcaactagctaatgtaaatcccaactctactaagacaagagtgatcttaggttctgagagtccccagtaccaactggatactataccacaggcaggaacacctcatcaggctactcaggaagggagtggaagaaatgagaagcattactcaccaacagcaatgaagagtaggcagtcaggatcctagctaaactcagaataaaaatagaccagaaaaaccagtatcctgttcctagaaaagtgaccctgaaaaaaaatgtgtttcagttcttaaaataatgcagaaatcagtagcatctgtgtcaaggatggggacaaaaccagactagataaggcataagcaaatgtagggagataaaaagaagcagtgtgtgaacagcagcttttgcggataattatatgaggagttttaaagttgtgttctgtaggcaattggggatgttcatggggtctgtaaacgcagtaggatcttaagttacttagaatacatatttaaaaattacgtcctcttttaaaaattaacataacacagaaatttgggaataccggaagagaaacaatacatcccataagtttactgcctgaacaaaactaatactttacactttggcaggctccttgtccacatgcatatgtatttttggacataattgcaatcacagccaccatattaaaaaaaaagccccaatttttctgttcctaatgtagcatatgagagaaaattgttaatgatttgttaggagaaacaatgttatacttgatctaggtattacacaaagaaatttgaatcttcatctcaagaaaacagaaatttcctcctctccgtacaaaacctggagaaattaaattttttaagaattaaactataggttagtgaacatataactacactagtaagaattataaaggaaattctcttggacaagagctgtgagataaactaggaagaaacaaacaggcaaagagccttaactagcaaaaggtatcccagatcaagactgggaagagtgctctgtagaagatgagctcacaatcaggaatcagaaaatatgtaagggatgtcaacaaatgaaccctatgagccaacaaatagaaaaacttggacccaaaaaaacataattaatagaatcagaaaagagccacaaaataaatatatttaagatcttccatgatgtaaaggaatgattcacatccatgaaacaagaataggatgttttaacccaagcacaggtggttattaaacagagatcttgaaaaaaaattttcgaaattaaaaaaaaaaacatgaaatctggccttaatagcactctagatgtagtcaaagaactaatcagtttaaccaaattgtgatattgactttgctttccaagtaacaaagaaaacttagtgtttgtcatttcatggtactcctctttcttctaatcattttactggtcacattgatattttattttaatccctttctacctaaaaggttttcttttggatatcagatcacatgtaaatattactattagtttgctttacttcaaagccctctcaccaaactcaagtgaagttcccaccccccagctatggattacaggcaaaagaagaactgtgatttggctttttctctctctccctctacttcttcccatccgggtaagtaactgtacttactgttggtgatggtagtggcgtgaaaaaagggagtgaaaagagcgagaaggagtttgcttatgtgactgcctgaacatcagtgggaactgaaaaaggaagtctcctttcttggccgtcacttctttaagctgagaatatacaatgctgatgactatgcagaagtcctactctatgtgaatgtgtccaatttaggcttcttctgacttagtatttttaagcagttttctctccgctctggaccattgtgttacatccctctagcagcataatcacacctccattttggatgtaggcctactcactcaaccaagacagctttactggggcagcctagtcaatgcaacctactcatgtaaaatccatattttctgttatcattataacaatgtttaaagaaaccttcaaggaccccttccctcctttctcacagctgtaagatgcagctttcttgcacctttccccaatacatattgcaatgttttatatcagcatcaccaactgtcagctgacagtaactctagatgagaaaaaaagataccatcgatggtggaggccctaggaaccctcgcacagtttgaaatggagaaacaacacacacagaggggaaaagagagagttacggttaccctaccaaaaaattctgctctttctagctaaggggaacaactagaaaagctagacaaaatgttttgaaaaatctaaatgaaagcatcagatatctaccagacagtgaagaactatgaagccaagatctaaataaggaaggaaatccagtgatagtgtagcatttggggtaatttttctctagaaggattggctgaggtacaggaagctcttgtaaacttcacagggctacaggggagaaggtaatctcgtaaacacaacacactttgatttggaaccttacagggttacattctaggagtaagcacaaacttttccagtttgtgacttgtgggggaaggaatcctagctttgaagcatctaaatgtgtgaacagacgttattagtctgctccccctaggtactggcttgatggcgtacacagcttaggcctctccctaacagtcctcttctacggcacacgtaggggttattttttatacagggaaaaaaagattctagatgaaagatcagaggtgcatgataaaatgaagagcaataaaaaaaagtaaatatgtaggtaaatctaaaagaatattaactatacaaaacaacaataatgtcgtatgtggttggaaaagtatgtaggattaaaatatatgatgagaatggcttataactcagaagttataagtgtctgaagaagttataagtatatgaagttaaggtgtttcaagatccttgtattatccaggaaaaggtgaaaatactaatataagacttcggtaagtcaagattacatgttgtaatttccagggtaggtacaaaaaagacagcaagagtgagtaggagagaaaatatgggtattccttccaatttaatagagggaaaaaatgaagtaataaaaaatacttaatataaaataaggcaagaaaagaggaaaaaagaacacagggctgggtgcggtagctcacacctgcaatcccagcaatttgggaggtcgagcgggcagatcacttgagctcaggagtttgagaccagcctgggcaacatggcgaaacctgtctccacaaaaaaatataaaaattagctaggtgtggtggtttgtgtctgtagtcctagctacttgggaggctgaagtgggaggatcggtcaagcttgggaggcagaggctgcaatgagccaagcttgggaggcagaggctgcaatgagccaagatcatcatatcactgcactccagcctgggcaacagagtgagaccctgcctcaaaaaaaaacaacaacaacaacaaaaaaaaaaacacagaactgataggacagtagcattaggaagaatatggatgtaagctcaaataaaatatattagtgatatattagtacagagctattttttatttggaacataaagacaaatattgccaaactggatttgagaaacccaaccatatgctatttataagagaaacttccaaaacatgagctacagaaaggttaaaaaaataaaggatggaaaagataaaccatgcaaagctagtatagctatattagttattatacaaaatagtcttcaagttaaaaacatatgaagaaaatgaaagactatgctgcaactttgcactaagattgaagacttcattggtactgagacttgtgcctgatttacaacactacatcctggcagacgaagatcacaaatgggggatggctgcaaggatgatcatggaagctagccagtaagcatctcagtcttgggaacaatggttagggttccaagccatgccggtggtcagtgcaaaagcctgttgtgagggatatttctgtaaaatgcctggaagagcaattccaaaaagtagctagggaccagtgcttgactgaggcactgtctaatgaaagtaatatgaccagagtgaccagtgtcattttgatgaccagagtttcttcttaccaccaccacgctatttttgctgtcttgtggtaagccccaggactttgataccactcaagggatggggagagaggcagaaagatttggatattagactttgcataaaccttatcaactatggatctcagagctggtattttaaaatttataaatataaataaataaattataccatagcatttatattttaaattgaaatacaattcctgtggaataattcagaactggcccataaatgaaactgcagatgaaccagtgagaaggctaactgaaaacccccaatgaataagtaggcaaaggaaaataaattttaaaagaaattagttaaataaacttgttctgaaactaaatgattcaaattaaaacaaaaaatttcatcaagaaaacattatgcaatattacaatatttaatgctgtcatatacctctgttttaaatagaaattgctataaccttttgagaaagtactttggcaacagacataatgaattttttttttttttttttttttgagtcagggtctggctctgtcacccaggctggaatgcagtggcacgatctcggctcactgcaacctctgcctcccaggcccaagggatcctcccacctcagccttctaagtagctgggactacaagcacacaccaccatgcctggctaattttggggcataatgaattttaacaacgtttattcttcttgactcaataatgccacttatgggaatctattctaggaacattagtcagaatacaaagatttatctgcattactagtttataaaaacaagaaaattggacacacatataatgcctaacaattaaaaatggctaagtgtattatagcatctgtcatgaaatatttttaaaccattttaaatgatgttcattaggagtttaaaaattttgttaaaatgtttattattttaagtgaaaagagaaagcaaaattatgtatacaatatgagcataatataaaaataaacatagaaaaatataacaagtgattatctctcaagagtgagactaggcagatactatattttctaactttttgcattttacacataaaataacaaaccatgttttacttctacaaagaaaacaacaactgtattccatttttaaaagccccatatccgaacagatccttctcccccaaataccaaataacaagatttgcaggaaggttagaagacatcaagccagaaaagggctgggaacattccagagtaggagtttagccatgaaaagggtactggaaagggatacctgtcactgtgttcagaatcgtaggaagcctcctaagaacagcagggagaggaagagggtataggagcagcagagaaggcagggttcagggatagagatcatgaagaccaactagtgtcaacatcagtaactcaaagagactaaagaaaagataccagggaatcattatctgagtagaaggactgtggatattggaagcatgaaagcttcctactgagccagatttagtctaagtatgagactgagcacagtggaagaaagtacaataggttagggtgctaagcatcctacccctgccccagaggcaggcctctcacccaaaagctgtggaaagcccagttttgtccgccttccctactatatcaccggatcttttcagcctgaggtagaatccaggtggctatcagaccaaaatacccttacacaaatgaaactacaaaaagtgaaactcaccagtcaaagttaaagtattcactggatgtttctatccacaggaacagcaacatcagagacaagacaaatgaaattaccaggcacggcaaaataattgctctttctgggaaaagaaaaaagaaatctaacttagctccatttatccttgttacctcagcagtttctgtatacacttgccaaaggtcagcatagttgcactgccatgcattaccctcctgaggctggagtgatcactctcttctttttacccctaccaaatcctgtatatgcctatttacaacctttcttacacttaactggaattatgcatttatgttttatctgatgctacactgtttcttctttgaggaaaaggaacgtctctgtattaccaatacatagcattgtttcttgaatgcagctggctctcaacaatcatctgttgaattcatctgcctctccagctatcaaatgttttgttcagcaattaatttattgattcattcatcattaattggttcatttagtcatcaatctaccccattggagaagaaagggggaatcagagttaaagaataattttttttaagtagctattttgttctagtaaaatgctagggaatttcacaagctactttcatttgatttatttctcattagagccatatgagttgggcatcaacctcatttttgcagaagaaagctcagagaggtaaaataattgattcaagatcacacagctaagaagtggcaggggcaggactagaacccagatctgtgtaagctcaaagccaaaatggaggttatcattatggagaaggtactgctttctctgaaggcaaagaagtctccctgtgttagttttgtccttttcaatacgtcctccacacaatcaaataatcattccaaaacacagctcagactacttcatcagcttaaagtctttggggattctttattcccaacatggcagaagtcaaattcttaaaaccacacaacattggacccatctccctctctagcttcttttcccctcacttcttcacattcatatcctctccttcatctaaaataaaccttgtatcagtctccaaactcattatgccctttgactactcctccaataccaattcttccaccatccccaattctctacctatccaattcttaatcacccatcaccttctaaaaggtggccctccccttggtatgtgcctgtgtacatgcgcatacagttacagcacttctctcactatattgagattgtgtgtgtacttatctttccccacagtagactgaattccttgagagcaggaaccatgcctgaagcacttgtattatccccagtgactagcatagaggccgaatatctgggcaggaaagatacagtggggacagaagaacattccttcctactgcagggaaacctcccatttcctacccctttccttgtgttccccacctcaggtataagaaattaatgacccaactggtctgattctgggaccctagttggaccatgtttacaaataagtaaaggtacatgattttgctcttctgttctcatttcagtgtgctgatcatttaatcacttataccatgtagctcaccaaagggttccaacatatggcttacaaatagaggccctaaaaaaggctagtccacgtgccaccactcagccttactagagttcttcctcagggaaaatcaccactagcttgaccaataataaaggagcaccttgtttctcacttgctgtttttttctcctgcgaagagaaattcacagaggagagcaaattacaattcaggcatccctgtaatccgtaaccaaaaatatctaattgcacccaaacatcactttttcttcaagattcactgaatgaataaatgcaaaagtgaattaatgaataaacataaaagaggtagtaaggaaaagtaaagaataaaagtgaaaaatgaagtgaaggaaagaaaatgaagaaagcaagtacatgtttcagtaagtttaacattggtgcaatacttttatggaagaaatggagccctagcatccccagtcctggagaccataaagagccctcatggggcccagcagtcagcctatgctccccgcatctgagaaaatgtggtccagctccttatcagtctgtacccaagtgcagcaacaaaatccaactttagttttttcccattgtctgaatttccagaggcaactatagcagccagtaaggaaggtgacaaagcatttgtggttgaagatgcgtggaatccatggattaagcttttttggtttttctgtcttattcctcttgtgctcaatcctgttgaccttcttaaacatgattcacccttt

SEQ ID NO: 294 - DNA, 245538 bp, Homo sapiens
gcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaaggtaaaaatcttctcccctccttctacgtggtggaaaccctgagctgcaccggccagggcagtcgtgctgggctcctcagagcaggctgttgcagttgctctgttcgcaggaaattatttggggcgagagggaaagagatgcagctcgcggtggctgctgtaccctttagcgtaaccttgctactcccccccaccgccgagcccctgccggctcctcggcccccacccccttgctttttgacaatgaaatgccggtcacaattggtcagagcaacccggattgtctccagaaccgtaaaacacccccgtaattagtgcgcttaaaaaaaaaaaaaacaaaaaacaaaaaaaaaaaacctgctccctattcctacacccaacatgtgactgaaatataacttttgttcccgaggggtggtcgtcttagaaaaaaagttgttcagtttccactgcgatagaatctttttatttttttaaaggactctctgggtctgatcagacaggatttttttccccctcgtctgattgtaattgcaagcgctgtcggagagacagtcctggtgtcagcttttcctaggcattgcacaatgaatttttttttaaaaccaaggtgaataaagttgctgaatagttattttactccgatccatatgaaagttgagcaatcccaaagtagaaaactcctgtgatggagggagaggaagaactaagcaaccaggcaaaatgaccttctgtgtttgacagtgcagagaggctatctaagcagcactctgtaaatgcagggcggtagatgtttgtaaacacactgctgggctacccagtagttgtgtgtatgcatgtctatatatctgtaaagactgtggtgctgcggtttgttgcttctaaaaagttgttgtaaagtttgccaccattgggaggcaggatgatttatccatctacccgtgttatttttcccatcgctgcatttattgtacactttattcatttcgctgttccaccagtacccaggtagaaagccttccgctcttgtgagaggctgaagctgctgaagtttgtttttggtttggcctatttaatgtgtgttcactgaatggacactacagcaacaatgaacaaataacctgttttcttcgtctgtggggagttagaaaaacccttcctggtttaacactgcctttcaattagagtctgtgtaggggaaacgcagtagttcatcatacgtgcttactaggttttttataattagaatcacattttggtgtttcttatcagaaaagatattcatgggtttgaggataggctaatgtgaaatcaaaaggtggtttgggcttctttgtttttgcctcacaaaaatgcctaatggaacttttaggcttttgtgtttgtacataactggaggtagcagtatgtatgtctgtgggcatggggcgtgccacactaaagaacttagggtactttgatattaatacttcaaaaccagtttcttttgcggtataaattagattctacacagagttcaggaaaatcctgcggtatagataatctaatttatttgacgcttcataacatagaggtaactaaatagtaggatattcaataaataaattgtatttggctcagtggcaataaacccgacatcaggaaaatctgccaactacagatcagtaactttagggcaaaaacaacaaaaaacaatgctttctgtgacgtttcttgatcctcttctatactgcatccccaccgttttgatgggcttatggtggtgtgctggctgcagactgctactgagtggtttgtttcattgtgctccagtcggaaaaagagtacaacagtcccttgccttactcacatacagaaccaatcccaagcaaaacgcgttcttaaatgcaacatgaaaattgtctgtaatttgcatatcatttttttccttattgcttacaactcagttctttcagggtgcctcttttcattactgtgtacttctatgtaattaaaatagatttaatgttctttaccagaaaggaaagaatcacttttattttggatcgttctttatggaacgagtatgtatttgcttagactgcatgtgtctaggtgaacgtatgtgaagagtatctttccatggagtttgtttaattcagtgttccaataataagcactagagatcaaggactgggattattccaggtcatctgaaatgttctggtgatgtgtgctgcgtttcatttagtccttgggatgtggtacggtgactgcataataaaaaatgtttgctggtaacccacaagcaagttgcttgcttctagagtccagtaaacaatatgcttttctgtgtagtgaagaacgaatgtcagaggttttcaaggatgagctgatgaacctgatataccgaactcctgtgacacaaaaggctctcactgtggagaggtttttcccagtcctcctctccactcctgaaaccgtcctcacttgctttcattccttacaagtagcgggtcagcaggcagacagttcctcagcggctggtgagatgcagccacagagggaagtactttgtttatttctgagcagtgcctgctctgctagaaaagagtagtgtccgatttgggtggagtttccaaggtgaaagtttctgaattggtcaatcagtgacgcctttgtaaagatggctcatgtggtggtcgctcgcaatgaatgcctgataagggcttttctgtttcttttgcactgtgtaagtttgctcccatcgcctggggaagttaatatcagacacacactttttacggtagaagagaggttgactactccaagggcactgaaactctcactgagccttattgtttctctacacgcgacttgcagaaagcaggagtgctcgagcactcctgggggggtctgtcctacaacccttgaaggttgtggcactgttgtcatggaagttcaaatgcttcaattcctgaccatttggggtcgtttaaatggaaggaaaggatcaactctctataaaaagtcaaattgttttaaagaggattgcctggctgactgtgctggtcacaggaagaaggaagaggctgtcttttccatcatcagccttcaccttcaagtcacctcttcagttctaagtttgaccaagttgcagcggaaggtggttgtggcctagcagacacggtcccttgtcaggcttggcacagcttgttagtgggccaggactaaccagaatccaaaaacgagtcacacagtgtctctagtcccctccttccctgctgtccgtatcagtcagctttcatagcagaaggaaatctggtttttaaaattttgctactaactgggagactctttcgagctccccttctggactctgggctccttgggtttagtgatgattatcttggtgtcctagtagttagcttggcagctggcatagaaatatttctcagtaatgtttgctgatgtgaatgaagtgagaggtgggaggaggccagccccctttcctctttctgtctgcgtgtaacctcagggtgacgtaacactttcatccactggcttgcttgcagaaagcactcaatagggcccactacagccttagagagggctagagcactcctggggggtctgtcctcaaatgcttattaatagaattttgatacaataatgttttataatttttttttggagacagagtctcgctctgtcgccagactggagttcagtggtgcgatcttggctcactgcaacctctacctcctaggttcaagcaattctcctgcctcagcctcccaagtagttgggattacaggtgcccgccaccatgcccggctaatttttgtgcttttggtagagatgggggtttcaccatgttggcaaggctggtcttgaactcctgacctcaagtgatctgcccgcctcagcctcccagagtgctgagattacaggtgtgagccactgcgtccagcgtaatgttttattattttgataaaattctcaaaaactgcttttgtgtcaaaaataacaaagaaggaaattgaggaaaaggtacaacaaaggggcttaaggaattgctttaacaggttcagattagcaggcttctaagtgccccccagtttttctgacaatagaatcagggaactttcaaacattcagagttgagagaccttagagatcccctgggccaacctcctctattttttacagggaggggatccagagagctaaggggtttgcttcaacccatgggtgagtgagccaggtttggaggacacaggcctacaggttcttaggccactgcattctctgggttcatggtgtgtccctataaaaggccaaggaaactcgatataataggcttcgctctctctggcacttcctagcttggtccattttaatcacaagccagctggtctgagggcacgggggtatgtgccaaggaagatggtatgtgggggtagaaatgggccactggggtctggtcaggtgtgagaagaggaagtagtaggagggaggagatgagagaagaagggcctgacggacttgtattggcaccactatttgcatcaatatatgtatatatatatatcttttacagtgcacaaaggcctgcaagttctgttttgggctgaaggccccctatctgctgttaggactcctttgaggaatccttgggtgggccgtaggctcttttatcaagggtcagacaatcctatttatactttaatttctgtgtagtaagctccctgtttcaaacagtcaaagctaaaaatgtggcagctggccctagagaagtagctatcctgctcaggataagtaagtcaagggcaaaaaataccccagatgtgagcaccagaggcaggtagagctaagtcacattctgctcctctgagtgcagctgtatttgtgcacaccaggaaagagctgggggcaaggtgggggcacagggttgctgagagtaactcacacagcagtttcatttttttcaccaatttttaaaacttgccctttggtgtggatctcccagccaagtgattcagtgtcagatgaagccccgtaaggtgtgccatatagaaatgacatgtttgttctatgtgaatactactttagagacaatcctggagcttgttttcaggtaagggtccaccacttccatatttgttgttagatgtgtgttgggaaccaatctccgtgtgtatttgttgaatagaatgagtgtgcatttactcagggttcccacgccaaaagggacccagcttaaagactgttcactgccaaacctagtatttggggacagaaagactagactaaattagtaaaaagttagaattatagcctattaaaaaacaaacacatttttattgattttccaaacatacaggaaccaaactaataaagtgttgcttactggggcatctcagggaacgttccaatgaataggcaagaatgtgttccacattatccattgggtagaaactagtgctacgatgtgcttggaactgttcctttagtgtcaaaatattaccacacattttatttgctctgttaatttgtttgataaccttttcttcttagtaaaaatacagagttcagcctggtcgttgtctaaatgatctggaattcccagagtgtggacgaggggcttgattagaaaaggtattgccccgtgttaagtgtggactctcagatgagcataactgctcactcagccctatggatttcgcttacaggaaacggtagaatgcttgcatttctgaaactttgtaaattctctgtaattaaaggtgttcgtctgctgttttagtggccgttgttctacaacaaccagttgtagcttacagctatatagtgatttattacaaaacactttcttcttctccttttccttcttcctcttcctcctcctcttcttcttcctcctccatcatcatcaccggcatcatttattgaatgctactgcatgctggtccttgtgctgttttatatacattatatacattatctcatttactcttcacagctctctatggatgcagtttttctctccattctacaaatgaggaaactgaagcccagagaggttaagtgatgtattggcctaagacctcgcaggctgtaagtggcaaagctaaggccagaatctctactgtgggactctaattccaaagtattttctatgagggcattccaaagtgcagccatttttgcgaagaaaattaggaaacttgaagtgacgggtggctggtggattgttacataagccgagatgagaggcaggaatagagctggcagaagtgcttgcagaggttctgaatttcctctgcttcctggtctcttctgaagatgggtcttcctagccattacacaagtagcggggacaaccagatggtcacacaaagccaccacccactgtggaatgaatgtctaagttttccatatttaccccagtctctaatgtcctctggtgaaattttgtctttgatgggtttcattttgggcccttgttgtttttctcagatgcctttcttttccttgtgtttttcttgcttcctccggtgcttaatggcttcttcatgaagcggttggaaatctgagagattgtgtcatcctgcccggcctcgggctagacaccttctttgcctgctttttacttcctggtcagttgcttctccttatacaacttttttttttttccttttaaagcttttcacacaatccataaacacaaatttttgtttttcttaaaccatctctcatgtacatctttaatattatgtgatttccaggaatctatttcagatattccctcattttcccctataacaaaaggaatcatctttttttgactcctgtctcgatggcttgacccaactcgcctgttctaatttcctggaatgaagagagcatttcggccatctgactttatacatttctgattttgaacgactctagtgaagagagtcttcagagcaaatgtagggaaagaaacagagaaagagagagatgtgttgtggagataatatgaggggattcagagagcattatccaaatttgtcatgaagcaaatgaggaaactgagtcttgtggcgtttaaagagcttgcctgagatcacattcctaactgatcaagccagagtcagaatcagtgttccatcctaggtccatgttcctctaacaccatagcagaggaaaaatgagaaaaaacaggcaagaattcagaaagcatagcttccttttgaagattcacatgacatattagtgttcatcattgtgacttccaagtgaaagacagagttcatgttatgagatttaagaagtgaagaaagaatgcaatgtattttggaaagatatctaacaaaaatggttggcataagaataatgttaagttttaaaaggctaagcttcagttacgtggatgaatgatttatgaaaagtactcccccatgaagacacaaaagaggtagccaatgcatctgcaagttcttgaggcctgatggcctccctgggggtattttccctttgtatgtgggagtcagatatacggaaaacgacttcatttcctgaatgacccaaaaaggacgcattgccctgctgagtgccagttggtgagtgtgctcaatggtgttagtgttgccacagtgtagttccagtcaccacgtctttcgattttgacttacattttcttctgtcttatgttgttctttggttcttacctgtaaagctgacttcccttcaggagattgtaaggtgctcagaaaagggctttacctcactgccatgctgtgaattctcctaggggaagagtacagacaatggagtagacagacccatgaatcctggttcctgaacttgaacttgttcaagctacttaatcatgaacctgttaactcatctgaagtggtaataaaaatgtgtctcttagggttgttgggatatgtacattgcccaatgtagtgctttatactgttaaaaagttagttctcctcctcctttatacatcctccataacacatggatctggaagaggctagagattttctggttctgtgcccacattatacagttgagaatacagaggccaggggatggtttgtttttgtttttgtttttgagacagagtctcgctctgtcacccaggctggagtgcaatgccgagatctcagctcactgcaacctctgcctcccaggttcaagcaattctgctgcctcagcctcctgagtagctgggattacagctgtgcaccactcacctggccaatttttgtatttttggtagagacagggtttcaccatggtggccagggtggactcaaactcccgacttcaattgatcctcctgcctcggcctctgaaagtgctgggattacaggcgtgagccactgtccccggcccccggccagggatgttaatggccttgctcaagctcgtgtggctagttggtggtgccatctgaactaaaatctaggcctcccgagtcagctgactccctgcacagtgctcttgtcactgtcccattgagttgttcacagggctggggtcactcagtcagtgctcaaaaaagctcttattttaactttaattgaatacaagcctcaacaataggagagatgagccaagtgcaattatatgataatagcaaatgccttttgcatcttacagcagaattttgaaggaatagctaatgtggttctgaataagtttccagagatgaaagaaaaggaaaaaacctaagtctggaagtactgtacagtgagtctaactagcattattactcagcgctcaagtatttgaacctattcagggatctgctccttcatacagttgcttattatttgtgactggggtgagacttgaaagagagcatcaattctccagtctgcttttgtttaacaggcagttccatgtctgtctgaccacagaacagacactgtttgctgtgggctggtgaatgttcactttcaagagcagggagtagatggcccttcgtggaagtttaattatacagaagagtttgaaaaggccaagtttgttactttggggcatggggaaaccttcctctctagcagatgtgaggggaccgaagtgtctcttttcagcagttgtattcttcttgctgtggacctaaattcgatcctaagtcattctttgtatgtacatggcagatgagaagatgaactatagactggaaaataacccttttttgaggaattgtggagaaaatgttacccacctgtccctcctaccaccatgcaataagtgtgggctacttaatactcttgaagcaagagtttaggtttggagagaaactgctcctctgatcttctcctggaaaccacaagtggaagtttgtgattttcttctcagctgccctgtcccctctcccttgggttatgacaggccgtgtaactttatctttcttaggacttatctctttgatgaggtcagtaatcctgcttcacttacgtcccctatacgtaagattgccataaccaaagatgacatgcagactctaaagcatttcctggaaaaaatgagctacagatagaagtaaggctcgtaatttaaaaaatcgaaccccagagaacagcctgtctctgaagttaaccattcccccagtactttctcttgtttccctggtgaaagtgtgaatctgggttgtggcaggggaagttctggcactgctaagaggtgaggaaggaagagggagggcccagagctgcccacctcacttgcaggtgtggcctggaagagtgccggggtctctaatgaagaatcaagttcaagggatgaagaggagttggcgaaggggcacaaaaatacagctagatagaaggaatgtgttatagtattcattagtataatagggaaattagagttaacaatttattgtgtatttcaaaataactagaagaattgtactgttcctaacacaaaagaaaaatgtttgaggcaatagatatgccagctaccctgatctgatcattacacatctgcacagatatcaaaatgtcacatgtacccccaaaatatgtacaactattatatatcaacaaaaaaaatcaaagagacaatttagaataagtatggtctcaagcctagtgactaatatgtggacaagtagatctgcactagggtatacaggaggaagtattatggagacttcataaaaagggagatggggcggggcgtggtggctcacgcctgtaatcccagcactttgggaggccgaggcgggtgaatcacctgaggtcaggagttcaagaccagcctggccaacatggtgaaaccctgtctctactacaaaaattagccgggtgtggtggtaggtgcctgtaatcccagctactcgggaggctgaggcaggagaatctcttgaacctggaaggtggaggttgcagtcagctgaggttgtgccactacactccagcctgggcgacagagtgagactctgtctcaaaaaaaaaaaaaaaaaagggagatgggggacatggtgggaatttgctaagctcttttgttaactgctttaaagaactcagactagggaaggaaacttctctcaagtttattgctggttgttatttccagaccatttgtctttcccaaactgcccttggccatcaaatcagactcctgctagagtaagcctcatggtagtgtctcttggctcacctctgtggttttgctaattattttcatgtattgacctgggatcacagaccaggcacccaaagggacagaggtgagttctttttctttgggcctctttggatactcataacccaagtccctgtgacaggttttggaaaaatggcacatctgaaggattggatccgtggtgcattttgtaattgctgtatcctcttttctttaaggtcttgctgtgtcacccatgctgaactacagtggcgtgatcatagctcaccgtaacctcaaagtcctgggctcaagtgatcctcctgcctcagcctctggagtagctaggactacaggtgcaccaccttgcctggctacttttttaaaaaactttttgtggagacgaggtcttgctttgttgcccaggttgctctcagaactcctgggctcaagtgatcctcccacctcggcctcccaaactgctaggattataggcatgaaccactgtgcccagccattttgtcctcattttgacttgagatctgggagattttaaagatccgtgtcatgagttcacttgactggtgctttgcacttttgagacccgtcactctcctgactaataggtcttgacggccactaatggccagcaatggctgggaacagcaggacactctcactttgtaccttttgatctggtctttattcaaagtggggtgaacccagtaggagagttgttgttttggggataaagtctgggtgacagattcttcaggctgggtaagtctcctgttctccccgactttgagacctgaatgacctgatttggctgactacacctccagtcccctggacaacagccagctcctttgattttgtgccatttagtccttcccttcatctgctgacgctgatactttcgggtgaggtggaaggagagagcatacctgttggtgaggtaagagtgttttccttcagagaaccaaagaaacaaaggctccctttctgaattttgtgttctgcctctttgcatttctgaggctccttgtgtctggcagggctgtgagtgaggagatgagggtgtgctcctctgcaggcagaagtcagctgtaggtcagatgtggctttggaacacaatggaatccagggggaatgttggcgagcacagcaaggctggggtgatgatcctctaatcttttgcagcgtgctgtaagagtatctttaactttcgccgagacaggcagggcaatgagcaaaaggacctcggtgttaggtaacatctcaagtagggcacctggtagtacacctgtcttgcatgttcccacccttcccaacactttatctttttgaagccatctacccttagaaaatgaacaaggagccactgacatagacagcaagtatatttacttatcttttgggtgcaaggcagtttgccctgctgggagagatgtgggataaggccccagagtggaaaaaaacaaaaaaccttaaaaatgcaagaaggaagaaaggtaggtgagccagcaggtcccactgaaaggccttgttattgcagcaaagagggaagaggtgggcccagtggcacaaatcactaacattcttctgacagtcactagccagttcttctgagaatttctctgtcttgaaaaacttggtaaaatggccaaatggagcttctccgaactagggggaatgcctgtgtgtgcgttcgttgttagccatcatgttgaacagtctgatttaagggaaagttggtctgtgtacattttcatttcagctgtggtctttgaaggttcaccatggaggaggtgtgggtggatgagaatagagtcttctgcctcttggttggcttatatgtaggttataggtgaatgtgagttcacaacccccagcctatttcttatttgggtgcacttttggatgacttgcagggctgagtttgggaaaacccagttactcttcctttatgcacatatttctgccagactaaatgccaaatagataattggaaagaattttcttcgcagccctggtccccaaattggtgtctgtgattcttcctagggtctcatattatgagagtgcactccctttaatcttttgggacctcaagtggggtctgtgtggacaagattgtgcttctttgagaaacttcttgctgcacaccagccagggtaaggcaagagttagtcctgttggctgggtggttcttgggcagttgagcatgcttagcacttgagaggtttctgttataccatttgccaaaagggacatctctccgctggtcctagtgccccagggcacaaatggcaggctttaggagaaaatgcacaatttcaggttcagtctctatctgcatttgtgtgcatgaatggactaataattgcagtgcgttgaacgatttctgcatattccaacacctagaaagtagcttcctggattagggaacggttcctaggtacagctaccaaaggctcaagcttaagcaccaacactggaggttagaattagcacgctctagggaggacagcgagagggcagctgacacaatgcctttatgggctatttttagctttagtcaggcctatctggagtggcttgtgctttcttgggcaccgtcctgcatttattccagggtttgtgcttgtgactctgtttgcatatatgccacatgtatcgcatgctcatgggatgataaattgcagaaattatggcataatctgttttctagcatatagaggaaaagattacacaaaatccagccttgttgtggcgaagaaacctaacatatagatgtaaaatatatctccttggaggcctggctttgtgatgggctatgaacggattgttaaacagcaatgtgaggggctgttagcaagctgtttctaagagcatctccctggtctggtctgaaaaggtgatgtgtacatattgtacatttgagatagtttgcctgtggtgtttatatgttggtaggttgtgtgtgtgtgtgtatgtgtgtgtgtgtgtgtcttgtctgtcttcagtggtgaactgaaaaaataaagtgttgtttacgtgcttctatgttagtgtctacattccaaactgggcaatagttttctttaagctggcttaagtgaagaggtgtttggtcagccacagggtatgaatcaaccaaacttcaaaaagcttcagtgtgtttttgataacactcttaagtatttaatagctgctttaaggatttgtgccttagtgtacttggatgaataggtaaatcacctccccatcagcaaactagcgtttgggttcccacgttggcaaagcagggttcctgttatgtgtctggtcatatttgaacttcttttcacattcaggtgacatagttgaacatcagtccgtgccagtttctgctactattgggtttttaatggaagagaactctttcttgttactacgatgccatgcttctgctgtgttagcagctgctgtattgaaaaacaggtgtctcttataatcctctgactggatcagtttgctagcctggcagagtcttattgttattgtttttatttatttatttttgtcccacataagtcagaaactgccaagagatgttgatgagtgggattagtatgagaggagatggcagcttttcttggtggaggtttctgttacaagaatctaagagtcttatgaagatagggctaaataaaaccaggatacgaaccacaggggagaaccgccaaaagaagggtagtaaatgaatggttctgtcaagtcacctctctgtcattcttcaaaggccaacttaaagccagcactgccacaaaagccatccaggactaaggttagcgaacggtgacccttgtttggtccacgatgcactaacagactcttccccttgttgcttcttactgctactggaatggaagctttgggagggcaggtgtgccatcttttccagcctgccaggcagtctggtgcatactcgtctttctcctccataccggctgtcactgccttccttctggccccagacctttcagttgtctcctctctgatcttccttcctccattttgtccccacccccaacacaacttggaatgattctttgcagataaaaatgtgatcttgttactctctgtctcacaccacagtaccacagtgtagcatgaaccacagcttcttgtcacctgcaaggccctttactgcctacctttctagtatcatctccacattatgttccaaccacataatgaacttttttctcaggaggacatggtctcgctctgtggccaaggctagagtaatctcagctcactgcaaccactgccttctgggctcaggtgattctcccatctcagcctcccgagtagctgacaccacaggcacgtaccaccacactaggctaatttttgtatttttagtagagacagggtttcaccaggctggtctcaaactcctgggctcaagtgatccgcccaactcggcctcccaaagtgctgggattataggcatgagccactatgcccatcccatgtaacaaacatttatgcctggaatcttccctcgatcttctttctgcctggcagccaatttgtcattggaagtccatttctcaagcctccctgttgctgctgggcacagtgttcccccagcttattgaacttgcttctgttattggcaacaatccagttatccttgaattatcatccacactagactgaaagcctgctgaggacaggagtctgatgggttcatttttatatttccagtgtccagctcaaggtctggcacagaggacagccaatggctattaattgaatagaatttcttaatcagtaggtatttattaagcttctgttacggacttaattggtgccaggctctttgatatgtaagataaagacctcacacagttgacatcctgagcaaatactctgtgagggttgaggaaagaagaaaggtagagacctgtgttttgaaacatatcaggactccatgtcagggcgaacatactgccacctcccatacctaaggggctcctgtgaggcataagtactgacatgtacacacagggcactcacaaatgctctccttctcagttgcctactttctagaggggaatatagatagctggagaagaagcttgagaaccttcaggctggatgtgccagaaacagcagagacagcccaagataaatgaatgtattaactgatcatccttttttttgatgtggctcaggatgcctcttgggtcagggagagagaaccagtggctgtttgttgtagctgtgtgcggtcttggccatagctggctgtggtatctgggacccagtggcaggtcaccaccgtatggggctgccagttgctcccccaccccattcctctaagagctagtagggagagagaacccggaagagcagcacggcttgctgaaacttctctgaggtctgtgattggcctttccatgtcaagggaagaatccctctcttacttgagtcagctctttccagtcttctcttgtacagcccatgttctctcctaccctatctgagatgaagatctctctggagctctcattttactcctaatgggttgcctggagggactaaaccagtgagaatgactgggcatactatgggactagaaaaacaactcaaagttatgtcttacggatggtaggacagcctcaatattgctgtttacagtggatagcccagtgacatttatttaaagagggcagtcttaagagagtgtgttagggttatgaatctgattaagtgtgatctgataagtgggaaatggaccacttgggagaaatcaggttactttcagatataagcagaccaaactgggccttccacacaagcctgaatagctcgttttctccctatttctgttgccattgaggtacagctgggattcagggcattaggatatgtgaaaacttttagcttcctgaacccaaccagaccccagcaagagtccttttacagtttccccgaaaccgtcacaagttttcctgaccgcctgctgggggctttctgttgcagacctacgcggcagctgcctgccagccctgccagatttgacttcatcttggctgccggtgggtcagtctccacgaggcttctcttggcctgtctgtccactcagggcatttaagggtcctcttgctttgctcacatgggctcctcgagggcttgtgcagtaggttgagagttgttacgggtgctgatctggaccacttagggagcagaaagcataggtctgtatatgaatgtgaaaatacacatttaagaagctgctcaggtaggggcagccacggaagttgtgctccctcttaaacactcagcgtacacacctcatcctcagacaatgtgctgcttacatttccagtgtccagcacggtgcctggcacagaggaaggccgatggatagtagttgaacagaatttttttaatcatcaggtctttattaagcttctattatggacttcaagtttcctccatgaatgctaccagaacccttgctcaatgtcttcactgttgaggctgttgagtgagaagccatttccttccccttctacttcccctccctttacagccttaccaggcccagtgttcagaggactcgatgctcatgaacctagggttcctaagaattagcatgtcacaatctaatctggagactatccgccatttagttccatggcggattatggtcttggttctagcaacctgctgaagaacaaacctggtggtttattttcttttttttttttttaaatggggacttgccttgtctcccaggcttgagtacggtggcatgatcatagctcactgcctcgacctcctgggctccagcgatcctcccacctcagcttcccaagtagctgaggctacaggtgtgtgccacgatacctggctaattttttttttttttttttttttttgagatggagtctcactcggccgcccaggctggagtgtagtggcatggtctcggcttactgcagcctccgcctcccaggctcaagcagttccttgcctcggcctcccgtgtagctgggattacaggtgcacgctgccacgcccagctaaattttgtatttttagcagagacagagtttcaccatcttggccaggctggtcttgaactcctgacctcgcgatccacccgcttcggcctcccaaagtgctgggattacagccgtgagccaccacgcccagccaatttttaaattttttgtggagacaaggtctcactatgttgcctggctggtcttgaactcctggactcaagtgatcctccagcctcagcctcccaaattgctgggatcacaggtgtgaaccgccacacccagctgagaacagacttttgaactaccacaactataggtctgttggacattgttttcagttgaaattgcttaaaaattgacctgccttggagaaaatttcatgagccttttcttaaagagtgattgaaatgccaataagaatgcaataacaagtgccctgtgtagatgtgtgggagggacaccctccccttcctccacccagcaaaagctaacgtactttccaaattctaaattgtgatgtgtgacttggtaaaggacttcgcactgttttgttttttttttttaaattgatgtggcaagccttacaaaaggatatgccgttatattctaacaaattatttctatcgaaaagagtatcatgtgagattagggctgtagaggaacagcctttcaactagtcttctatgtggtaaaggtggcacccagtttccaaagacagcacagacgccaagggtcttttctgaacttcttcgatttttatgatccctggctgggtcggagaagggctagttagtatgtttttctttcttctggatgaaagttgcaaggacacttaagccttatgcttcagggcggaatctgatcacaagttgagatcaggaagaaattttccccctgtggcttcctattgcacaattgcccggccaggtgtgctacctctgttaaacaaagacacacacaagtgcacacctccttactggctatcttcagagcaggatgttggacgttgtgggccagcagactggttcctttggcacatccctgtgctcaaagatgggaggcagctgcccgtctgctcctgtacttggctgtcctctgggtgtgctgtactgagctcagggccacgtcttcagatccctacaactctttgcaactcttactttgtgggacaattaaaattaggtctaattctgtacacacccgcatgcacatgcacacatatctttttaaaagttttccttaaacttgcttcccctttcctgggctttgcttcccccttcccgggctttacaccacatcaaacctatatgcattcccaaaacatcaaaatgactgttcacaaatcatagtagaactctttaaccataaggtgcgcagttgccaatctcaagcttggattgtaagcgacttcgaagtctgatccaaaagactgtgggaggagggggaaggaacatggatggacttctttccttcctccctccctccctcctttcctcccgtcctcctgtcctcccttcctcccttcctccctccctccctccctcctttcctcctttcctcccttcctccttcctttcttcctttcttccctttcttttctctcttttctttctttcctttcttctttttgaggcctcggctgtgctgcctcttgtgcaataggataattaccagcgattcccaggctcgcctgcttttctgcctttacatctctatctcctgtggcgcagtacttccttctgcctctattattagcttacttagctttaccattcagttctccacctcctccccgggtccctccccatcttcttccagcctttctttcccttcacctctgtaaaggtattttggggagctaccattcatgttctgttcatacaggaaccctctttttctttattaatataaaataatcttggtcctgcctcattttatcatatattcattcgtattcccaaaatagaaaccgtcgccaccagcacgtaatgtctggcctgtaaacctttaaagtaggatgtgccgaaatgagatcttcacaagcaggtgtgcctcatcccctgacctgcaggcccttcttccccggcggccattcactcatcttcacaccatcttcttgcccttctctctgcttttcgatgattctaccccaatcacattccttcccaaaatgactgtgttagtacttaattgttcacctgggcttgttcatgttgtagttcatcgtttcctttttatctttaaaattttcttgttcttcggggatacactgtattcttgtaattagagattatatcagttttcatggccaaaatttgccacgtggacataatagtatttggtatcaagcacgcctttcaggaagaagggaaaaacagtagattttgggcagcttttgattacaataatttcaaatttctaataactaagaagtacttcatgtgattcttgtagagtaaaagcttaaaaattacccttttctttgtaagtgatatgagtcttacttcgtttgggtaagaaactcagtttgaggctaccaatttttcaaatagtggtcttagaaactaattattgctgtaatttcaataactaaataggcattcctattcaaacctttactcaagtagttatattctttaactatagttactcatttgtaacatttttcactgtaagggtagtgacatcctgtttgtaacacaccctgtcctgggactaaatggaagggattgaggaaattctgctggagtctaaccccaccatagggcagcagcattttaggaacaaaagcagagaagctcacactcttctgagtataactggggagaagatttagggaggtggcttgtaggatcagttttaagaccaggtcagacatacgtacaaattctttctttgtaaatgagaagtggcctttaatagctttcatatggatagatgggtagatgaaatattattctacctaaagcatgacatttcagtaagtactacactttgaaacttgccttgcagggttttaaaaatattcttttctgggttctaatcatttataacgaagagtcactagcattttattaaaacccatattttttggagagggatattaagtgagcagggattgtgggttgttcttgcttttccttaactgtcctgccccaaaaaagtgatgggaataacccaaaccttaaaggttcctggggctttctttttccctagacagggacctcctcctctcccctgctctcatcccacttgttcctgaaaaagggtaaggttggcagggcggggaagagagaaggaaattagggttctagcttaaaactgctgctagagtggctagttctgggagctttttgagagaggcccaaggtggcagccttgtctcttttgcctctttcattaaacctggggtttgctgtacaatgctttgggtctcctgtcccaaaaataaagggctgtggcaagtatcatcctgacaactatccaatcagttctgactgagaggcacttgtaattcagaagatagtcattagatttggatagaaagaaatgagatgtgatgttcagtagatcagtagggtgactatagttcatgttaatcgattgtacattttaaaattgcttaaggagaataatttgaatgtttctagtataaaggaaagagaaatatttaaggcgatggatataccagttaacttgatttgattataaatgtatcaaatcattacatgtaccctgaaaatatgtacatctaatatgtatcaataaaaataaataaattcattagaataacagaatttagacatttagagctatagttttaaggaatttcagaccaaggcccaaagctcggttaagtgacctactgaaggtcccaaggctattattgccatattagaactagaagtcagatctcctgactcccaccagtgtatattgacttttgacccagcagttagttttattttaggctgtattttcgaaataacagattggttcaagtcaaaataatcttattcgtgtgaaaaactcaaccaggtgaactgagtgaatgaacctactttttaattgggtgtttttaggtcatgtgaaaaaaaaaaacacaaatcagaaggtcctttgtgcttcatgtttggatctgatccttttttttttttttaagctgaaaatgaatgaaggatggtagagtaggaactaggatgtacgcataaaacacttgcctgtctgccttgtcacctgcactccagtggggtgtttccagggctcattgtaaggtgagaggtgacttctggacccttgactaccctgttccttctgtcgcaaaatataatcaggaggtttctatttgacaatgtactctgagtattgtaaggaaccaactcccaacccaaatcgaatcgcctctgagatcctattaaacagaaaatgccctgaacaccagtatatgaaaatgctttgctaggatgagctcaaagcatttcatcctccaaataaaatctatctgctcacacttagattgttcaaaggcagatggtaggcaattgaaacagagagacaagctggcaaaaggaaaaataaaaccacaaatatctgcacgtgaaggtgatttacgctcttgccagcccccctcctaacttcgttaacacaacgacgtagcaattaagtagcatgggaactcgggctcagatggctgatacagttgtcctccgttaatggggtgagacaaagcttgcgtataatatacagtgctcttcaccaaaatgcagagctaaaagagattttaagagataatcagcaacatagcctgtaaatcatgctgctcataacagacggccaccttactgaaatctcactgacccccaccacacgtgttaacagcagggccactgctctgaaatattagctattaccgagtggccaagtcttaagaaagggaccacttggcagtattgaacttcaaagtggaagtaagatccccttggggtgagggtaggaaggcggtgaacagggttgatcagaaccgtggaagagtccggagcagatgctctgtgggaaaccctgaattagccaagagcaaaagttatcgccatcctactgctctgggaaggctgcctgttggagaaaacctctgtgttcccttagccttttcactgactggaggactttccagacgaaatctggcacttctcagtaaccttgaacttgaacattcagtgacagaagggaaagggagagggtttcagctgctggagctgggtaactgtgcagggctctcgcagcgggccatttgtggctctgagggtgccaagctgcagtgttctgagggtgtgtgaatgagggtgttgatcctggctgcagaaggggcagctttctgagcaggtgggagtggtgaatgaggaggggatttggcggggcaggatgtgagatgagtttactctgctgggaaagaatttggagatgtccatgaagaagaaaatctggatgactattgagggagggctgatgttggagagaagggctcatactacaaatcagaataaaataaaggatatcttagtatcaagaggaaagcactgttaagatactaaaccttctgctgcccaggtatctgaggagagaccatggaagagttctatatggaacaaatgaaaaagcagtaaagtcaggtctagacctggagtttttagtaataccaagtttacataggaagtgtctgggaagtagtgattagagggaaagtatgttggatgagtgaatcattccttcagaaatcaatattttttcctactaggccctccgaatgtcatctttgtagttgcccaaatacatcagtttctctcttatgtaagagagcttgtctcatttttattgctgtattccattttcaagtgtcttcttgggtaatgatcctgtatttgatcttggccagatattatctgtgactgttgttagagtgatccttttcctttcccccgagttagtcaaactgtgtgcgtggtctctagactgagatttggcagtgattccatggctcttgtgagtggagttgactaacaaaactcaggaatggaatggccatattttggaatttggttgaagcaagtaaagtttttattcttctaccaatgcaaatctatctcagggaatttctctttattcagaaagaatgacctccatcccacctttctctaaaaggtacaaatcgtaatgcatatttgacacattagttggcttttaccttggggaccagcagaccaccccgcagatacaatgcacggaatctagcaaacaataaagagcagtgtgctcgcgtggccagatcgttcgcttccttcctttttcgccttcatttttgggaagtccttgcctcgttagttccataggccatgagacatagcaatataaaatgccagaggatgttcaaatgggcgtgtggaggaagagggaaagcaggaattctgggccaaagagcagatggccagccagtgacctaggaagggaagctcaggcttttaaacaatggcaatgtttcttttatgtgcagttttcattaaggagtaccgagactccaagttggaggattctgaaagtggtcatagagtccctgccctcgagatttaatatccaaagaggagacagtggttttaatataatgaatatatgcagaaaacagccggagacaatagaaacactttggcaccttctgtggcgctgctaaaatgtgtgctgtagctcaaggcccataggggttaatgtaggggttatttgtgtgtgtgtgtgtgtgtgtgtgtgtgtgtgtgtgtgtgtgtgtgtttggtgttttccccatgaagccctgattgtgcgaccctgggtgagccagctgcttccgctgttttccaggaaagcatgagtgtccaccacctagagagatgatgatgtgagaaggggcagggagagacctctctggctgccactctctcactgccccaggagcggaggcccctggtgctcaggagttctttggctgtgtccggatccaccaattccccgcttccctaaggatgacgggtaaatctggtgagacccgctgccctcctaatgttggaggaaagctggagcccctcagtcaacatttatggaagggatttaatgcatcatgggctgtgaaggtacagccaggccctccgtcagctccctgagacaggccttgtctttttgcacgcatatgtctgttaatagttgtagacctagctgtagccatgggggtaagcctagtcctccagcccctgagagtttattaccacaaggagtgagaacaccaggatgtgtttttttagatgttcttctgtaacccccaagcacctgtagctcccaggtgtttttacattgatctcagaattacccagaaaacattctttgaagaccttgtagagtctgccatttgtacttctgctacaaagagcaaaaataaagcaaataaacaaaaagcccctggaaatcctatagttatcctaatacatattttaaagtattacctatcactgagcaagtgcatctatacatttcaatccttttggaaaatatactttctcaaacttcatgttgtatccctctaaagttagttagcacatattgtacattcagaagaaatgttcatttacagcaaggcataggttttttttcctctaaaagaaatttgaccaggtatggtggctcatgcttatattctcaacattttaggaggccaaggcaggaggatcacttgaagccaggagttctagactatcctgagcaacaaagtgagaccctgtctctataaaaaaataaaataaattagctggatgtggtaatgtgtgcctgtagtcccagttacccaggaggctggggcagtaggatcccctgagtctaggagtttgaggctgcagtgagctatgatcatgccactgtacttcacgctgggcaacagagtgagacctctgtctctaaacaaaaaggaaggaaggaaagagggaagaaaggaagggaagagagagagaaggaaaggaagggagagggagaaggagggaaaagaaaaagggagagaaattgatgcaggaagaagaaagaaagaaaataaaagaaagggaaagaaactgatgaaggaggaactgggtacctagaagtggttgaatgaaataatcctgtaaagtcatctaaggttcccatctcattccttgccttttatttcttgccatcacctatggccacttcttgcttgttcatgtcactttctttgtcagtttggaatgggccctgcctggctgatggctttggagaggacagcagacagtcattagagactagaagctgccaagcgaggcaacgtgacagagcacacagctttatgcctttttcttagtctactctcagcttggaaatgtaggagttatagtgacacagctcagtcagcctcttcctcccccgatcctggatcatccactctgcctctccctcccccagtcccagatcatcctgttttcctagaccattccttgccctgacaaatttctattactctcaggttaaagcccaactaaccctgaccaggctgcaaggccctgcgtgatctggccctgtcccttgctctttgtcttggactgcccttgcccacaccaactccttagcattctacagaggtgccatcctcttctctcctggcctttgcccatgccactccctgaaacactccttctatctctcttatcccagctgatggctctttcctaggtcttatctccctggggtcttttcttgaactcctcaaatctggatgagatgtccctcatatgtgccctcatgacatccgttttgaaacttctatcacatcaccttgtttgtatgcatcatttgtcaataagcccacgagatcagagcccatcttggttttgagcttatgaacatagtgttgggagtaggtttggtgctccataaatatctgttgattgaaggagtgcgtggaaaacagaatttggtctttgatttttttctgtgtttggctcagtgtctgatgctctcccgagcattcttatcagtccacaggattttgcaggactattagcagagggtaatgcatatctgcaatattgtcagacatcgcctgttgttagacgtttgcttatgcagggaaaacaatatggagtttttaatttttagttggaaattcagaatattaagttacacataacctgcagtggtttggtttttaaattgagtttctgcttgttgttaaacccaatccgaatcaactaaagggaggtctattctctctacaaggacactgtggctctctggatattcctgtaagacaggaaaaacgatcacagatcaattctagttgctgcctctgagaaagaagaacaagatagatgggtctggctttgtgaggaacctttctctctctcctccctcctcctgcctctctctctgccaataattacaaagctgaactgaactgctactgagaatccaagttctttcctggctctgactaagagaacatagatagcatatgcatctagattctttggctgtatacggacatatatacatgcacacacatacactctgtctttggcctgaaatgacggcactgcactaagacctgttgtttgtttcttaagcagatggatggctagatttttctttatatgaatctttcatgattacttttactaggacagagctaaaagaacatgggatgtgaagtccagtgagttggattgattggatgtatgcgtattgagcacctgttacatgctggacattatcagaattatccgggtgaagaagatgaggcctctgattgaagtggcttgctgtgtaatgtggttacactagtgccacttactctataactttggcggacaaattactggacctctttaaacttcccattgcttaaccgtaaaatgaggatagtagcacctactttatagtgtttccaagagcatctaccatgataatgtttgtaaaattcacttgacatacacctgctcatccttgacatctcccagtgcagtcaccggagcgcctcccagcgtcctctggcacaggtaggtgcttcccctcgtgcagttctctgcttggacacttcactccgtgctgtcagcaccctttgcttctgttcctgcacttgtgccaaaccctttggatgaagagcctcgttgtgcccatctctggattcctagtgccaagcatggggtccagcacttgacacatggctgttgctgaataaattaaagaacaaggattatggatggccaggtaccatgcatataacatccttattataagaactttgggccagaaaacagaacaaaaagggagagtgctttgaggccctggagatcagagcaaatctcggcaatatcacgctccaatttgaaggctgtaagtgtgtgctgctttttagcatggatgctgatcaactgcccgaggtaaaggaacctcttgaggtcaggaaggaggtctgtatgtttagtctggaggtcagtctacattttggttagctaacaaaactaacagacctaggtggttggcaattagaggcgcattttgattgttttatgccatatactctacaactcacatggcagcacttttttcctcctgatttcctttccctttgcaggaagaaatgtgtttctccttttcttggaatctccttattttctgctccgattatatcccttttttctgctgttcatacaatttcaagaattaatatgagttatgagggttctccagagaaacagaaccacaaggagataatgtatttatttattatgagaaattggctcacgtgattatggagactgagaagtcccatgatctgccatctgcaagttggagacccaggaaagccactggtgtcattcaatcagagtccaaaggcctgagaaccaggggaattgatggtataaatatatcccagtttggggattggagaagatgagatgagatgtcccaatgtaagctgtgaggcaggggaaaaaaagggagtgactggtgaattcttccttcctctgcgtcttgttcttgttctgttcaggcccataatggattagatagtgcccacccacattggggagggagactgctttactgttcaggagctaatctctccggaaacaccctcctagacacacccagaaataatgtgtaatctgggcaccccataatccgagtcaaattgacatataaaattaaccatcacagatattaatgtcattgaggttgaaaggagagtgttcttgtccttagtgtgtgtttgtgtaaatacaatttctaacacaatctgagtgtgcaggaaataaggaataagcactttaggggaaaagatcatgtctcaaaggatcatttttttttctttacccacccctttgactctcagcattgaaatcaaagtaaggccctgagcagctatatagtagaagaaagaaagaaaaaagtaagaccagatggttgtttggaaagaaacagccactcttagcagttatgcacagcataggtagagtaagttcttagtgctcgataaatgaatcaatggttgcactttttagaaagaccatttcttcttcggtaaagcttgctagttcttctcacagattctcttttcatccgttccataggttctgcacactggtgaagggtaggaacagagtgatcttttctttccttcttgctgggtttgccacaaagcatgttgaatggtcttgatgtttctccggtctataaataaatacttttttaaatggagccatcatgggatctgactctatttattcttgtcactctcttctctcctcccacagggaaatggcacatttaggaagagtttccattatttgtaacatttgatgatttgtgtctttcatagaccatgtatcagaggtggagaaacagcttcttaactttcagacttgcttgttcttgactccatgagccatctaggagagttaccccatttctgtaggcatccatcagtattcatcctctgtgttcacacgctttctcattatattactcttctcaagtttacaaatctcttctcattgatttcattttagtttggcatcatggtctagtgagactaacacttggctgggaattgggactaactgtgtccttggataagactcttaccattctgggcttgtagtttttctctgtaaaagttgagacatccagcttgatagttctctggctataagggcattttgacctccgaatactgaaaggatgcaggtaggggttgcaatctttcatgctctgtactttgcaagagtaatttggtcagctatctgaggcattcccatgagaaccaaatggaactactctggccccttcagatagaaactgttagaaataaaaagcttacacttgttggggggcaggcagtatattttacatctgctgataatatgctagaaccaaattgcaaagtgtacccatgtatgttatttagtattttcattgttcacatttttctcatttctaaactatgttgaatagtggaatattttgcttcctttggttttgtttgagaacctcttctccccttagtgatggtgctgtagctgtcgtcagcccaaaaggtccatactacatgttcagctaggacagggaccacatcagggcaggcatctcatataatttgactcagccctaatacactgattttcttacagccaaggattaactctctccattaaagactcatgtgaggggaagaacagatagcaaagtgtttgctaaaatgatgaactgtccctatttcaccttcaggcagcaaaatcatctgcttagaaactaattagagcattttccccaggcgttggtgatctacttctacatgcctatgatctcttagacagtagttgtaccatgttcaggaactggccataaagcagccctctccctagcctgtctccctctaatagaagaaggctgagagtggctcattccttcagatgaatctcagaccttttatttcagattcatttaagggcatttacttctctgtgatgctccttactttctgttctttaaaatcttctttgcttttggatcccagggtagacaaggaaaatgttgcaccatcatatataggtaggtaggagactttaaggtgctcaaagcctggtcgacattttctggtggcacagatgaagccattttctatggaagcctcctaggcaagactctgtcctgcatcccactgagtatagacctaatttctttctaatatggatggaggaataagcatggtcatttatcatgctgaggcagctgtaagccgtctgcatccgggttccattgcaattggaacagtagcaaatccattgggtttctttgtttttcagggtaattttctttcccttacagtgtactacagatttggggtctgtggtcttaagtgaacatttacataaagttagctatttatgattttaaacaaatttcatgcccctttctgctgtgttgttggtatttttggtttctatgtatcataaaccacagaagttcagtgacttccatggaatgatgtggaaaatcaggaagtaagactgaaattaagaatgaaaatttctgactatatgtgtcatgctcattttcaccgtttaaggtctttcagaccacaatttagtgaataaatctatatagcaaattttttaaattctcacgttttatttattattattattatcatttattattatactttaagttctgggatacatgtgcagaatgtgcaggtttgttacataggtatacacgtgccatggtagtttgctgcacccatcagcccgtcatctacattaggtatttctccttatgctatttctctcctagcccccacccactgacaggccccagtgtgtgatgttcccctccgtgtccatgtgttctcatgttcaactcccatttatgagtgagaacatgcagtgttaggctttctgttcctgtgttagtttgctgagaatgatggtttccagcttcaaccatgttcctgcaaaggacatgagctcatccttttttatggctgcatagtattccgtggtatatatgtgccatattttctttatccagtctatcattgatgaacatttgggttggttccaagtctttgctattgtgaacagtgtcacaataaacatacgtgtgcatgtgtctttatagtagaatgatttattaccctttgggtatatacctagtaatgggattgctgggtcaaatggtatttctggttctagatccttgaggaatcgccgcactgtccacaatggttgaactaatttacactcccaccaacagtgtaaaagcattcctatttctccacatcctctccagcatcttttgtttcctgactttttaatgatcgccattctaactggtgtgagatggtatctcattgtggttttgatttgcatttctgtaatgaccagtgatgatgagctttttttcgtatgtttgttgaccgcataaatgtcttcttttgagaagtgtctgttcatatcctttgcctacttttagatggggttgttttttccttgtaaatttgttttaagttccttctagattctggatattagccctttgtcagatggatagattgcaaaaattttctcctgctctgtaggttgtctgctcactctaatgatagtttcttttgctgagcagaagctctttagtttaattagatcccatttgtcaattttggcttttgttgccatgcttttggagttttagtcataaagtctttgcccatgcctatgacctgaatggtattgcctaggttttcttcaagggtttttatggttttataggtttttatggacctaaaaccataaaaagtctttaatccatcttgagttaatttttgtataaggtgtaaggaaggggtttcagttttctgcatatggctagccagttttcccaacacaacttattaaatagggaatcctttccccattgcttgtttttgtcaggtttgtcaaagatcagatggttctagtcgtgtggtgttatttctgaggcctctgttctgttcattgttctatatatcagttttggtaccagtaccatgcttatacagcatatttttgtttgcactttcattgtgaatgctaattgtttttacttaaagattcctccttgagtagattcaataattcaaactggacatgaacatgtgactttttgagatggaatcgctctctcgcccaggcttgaatgcagtggattgatctctgctcactacacccaggttcaagcaattctcttgcctcagcctcccaaatagtggggattacaggcgcgctccaccatgcctggctgatttttgtatttttagtagagacggggttttgccatgttggccaggctggtcttgatcccctgacctcaagtgatccgccagccttggcctttcaaagtgctgggattacaggcatgagctactgagccaggccatgtttgaatttttacaagactaatttaatttcacatttcataggtaacacatagacttagccacatttttcatattggtgcctccatggtagataagacattgaaactataatgcaactaagatcaaattttttaaatgtcagaataactttaataaataaatttgctcatccttttttgatggaccctaacaatgatcagtttttagccatgatgttatctgccactagactgtattattttctcatttaacatagcttcatggtactaggaatggaaggaggaaagggggcatgaacttctcaagactgctttgtaagtctatttctttctttgattcccatacctcaaggaactgagagcaaactttgagcctgagtgtaaagtttgttttcctggaaatgtcaccaggctgtaaactcagaaacagattgcccccaaaaaattccctaaagggctctttacttttttcttgtgttacctttttttcctgtggcattctgtctcataatatgaacctcatatagttgcctcccaaacttttctgtttagcttttttttttctctccaagaggaatttctttaagtacactatggaaatgtgcataaagatgaaagcctgacttttctaaacactgtgttataaaattaattgacaattaattcaacagatgtgtattgccacatggatagagggtaaaggtagtcatttgtcactgacttcgacaactgagaaaaaagtgattcaagggagttggccctgcatgtaaggaatttcaggaacaatgtggtcaattaattttacttaagatgaatgtaaacatcatgtgtacatgcagttctttcaataaatacaaaataattgtaaatgataaagtggcagataaatcttagtggcagataaaccagtgcctctaacaatccgcttctgccctgtggcattttttgaaatgttactaatttgacagactaaatgagcatccagtattatttagcttttaaaacatattatttgtgtttttttcctttaatattttgcttagaaagtctttctctactctaaggtcaaataaatgttcagttaaatagatggaatattacctgtttcatttttacattcaggccttaagattttattagagaaacttccacacatattcagaagtgatgagaacagtataatgaattatatgtactcatcactcggcttcaacagtgatcactacgtgactaatcttgttttatctgtatgcttacatccttctcacccttccccttccctattattttgaagtactagtcactcagaatttcagctataaatacttcaggttgtgtctttaacagacttaaaaaccaagcaagcaaaatgtcattattacacctaataaagctaacggtcatgttttcatattatctaattaatacctagagttcaaataaaatgcctagtatttttggggctgaagatacaacccataaaagtaaagccttggtgttataatacccaagagccaatattctaacgtgaggaaacagacaaaatgtaagtaaaatacgaacaagataatttctgctaacaatcagtgctcggaaagaaacacagtagatgacagagagagtgacgcagggccagggggatcctattccaggtcggtggtcagggaaggcctaggaggtggcatgagtgtgaggaccaggtgaagggcaggagctggcccaggggacagtgtcctaagtggagggatttgccactgcgtgaagagcttgatgggcctgcggagtgtcatctagctaggcacctttttccctgttaatgctggctttagttatagtcatttgtaatgtgtagattttcagtgtcttaacttttcaacagggtaaataggaccatccggagtacaccaatattgagctttgtgataccttttggtcgatttgttgatcagttatgcttcattgtccatgaacatttcagaaaaaaaaaaaaaaaggaaaaaaagaaatggaaaattcaggctacttaaatcacgcctttgaaacctagaaacccttaggggcacagacccttcttgtgtaataacagagctctattttctgctgggaagttccctattgagatttgggacacttcctaattttttctgggtaaaataaaagtgacaacttttttttctaatgactttttaatacttcttcttatctgagtaaaaaccaggaagtgggaagcaaatgtacaaaaaccagcaatacacacacacgtgtgtgtgtattttcatgtacatatgaatgtgtatgtgggtgataggaagaagagaggatgcatagagaagatgatctcgatcaagtttgatgtaaatgtaatagcaaattagagtacattcttgtcttaatcttttctgtaataaagataaaatggggcattatgttcatatgattgaacaaaagtggatgatttcaacctttttcttctcagccattaaaagaagaatttgaaagaaacagtctttgcatacatatacagagagtttgtcagcctttcttcagacacagccagccacagtcagactaaacattcgaagacgttacatttagtccacagtggaagtatttgttgattcacatattttctttttacaagaaaatcttcagggttagtattcacccctgaattggacacaaagtaaaattccattgtgttataagacagcttaaaatatctttgatttaatccagaaaattctatcactcttactcctgaaaaaggtgctggtattttaggctttaccagtcagctacattaaaagctgtggatagttttgcaatttatgaaataattactcttcctcatttgtcttcttgatttgcccgacatcaatgctcttgtgttcaccagggactaatgattgtatttttcttcccagtgggtgggataggataccagtaggtgggatagagagtttatggtagattcagtttgtctttatttactcaagcactcttccagggcctggagctgtcaaaggtgaagtaggaaattactgtttacatctgtcgggaattcactgttctgtctttcatgagctttcatgccctttagagaccattttgcacaccttgattgtcagaaaagggtctgggatgtttttggagtggtacagagatgcatacagcaacttacactgtcatgactttttttttgagatgcagtctcgctctgttgcctaggctggagtgcagtggcgtgatcttggctcactgcaacctctgcctcccaggttcaagtcattctcctgcctcagcctcccgaatatatgggactacaggcatgtgccgccacacctggctgatttttgtatttttagtagagatggggtttcaccatttggccaggctggtctcgaacccctgacctcaagtgattggcctcccacagtgctggtattaacaggcgtgagccaccgcacctggccctgctatgactttcaatgctctgttgtagttttttcttaaaatttaagtttgcttggcaatacctttttttttctttcttttctattttagacagagtgtaactctcacccaggctggaatgcagtggcaaaatctcagcttactgcaatctccgccttccaggttcaagtgattctcctgcctctgcctcctgagtatctgggactacaggcgcacaccactgcacccagctgatttttgtatttttagtagagacggggtttcaccatgttggtgaggctggtctcaaaactcctgacctcaaatgatctgctagccttggctttccaaagtggtgggatttaaaggcatgagccactgccccccaccccaccgccccaccttttttctgttcttttttttttttttttcagctcactgcaacctccggctccccgctccccacgccccccaccaggttcaaacgattctcctgcttcagcctcccaagtagctgggattataggcacatgtcaccatgcccggctaatttttgtatttttagtaaaaacgaggtttcaccatgttggccaggctggtctcaaaactcctgaattcagatgatccacccgcgtcggcctcccaaagtgccgacattacaggcgtgacccgcacccagcgccacaccccctttttttcttaataagaaaatgagtagacacatccctgggtgccaatcactcatgtatcaagattgctgagtatgagaaatcagtaaattaatatgaagaacttaaaacacagttctagccaaagtaatgcttaataagtacagtattgtgcaattattgctaaatagcatacatttattgtgttcctccatttaagatactttcaagcattgtagggaaagaaaagcacataagctgtagtctttagctttaacggacttgtagcctagttgagagaagccatatgtgtaagatgacgagtaatagcacaaagcagtgtgtgatcagtgccaaatgcaaatatgtactaaaggagtttaaagcacagagaaagtttgctgtgaactggaataatgataacaatggtagcaacagcagccagcatttactgagtgcttcccgtgtgctaagtactgatcaagtctcttacaggtattcgctcatttattctttatgtcagccatataagaaagatgtttctattagttttcctgctttacagctcagaaaactgagtgaggttagctaacaggcccagggtcccacaccagggaaatgtggagtctgggctgcctgttagagtcttggctgcctgactccagagccccagtcttagccacgtcagggtggtctaggagaactggatcgaagtagataccttacgggcaaaggaagccgaccacctcatggaagagtctggtgtatacaggaaaagagtgaaaggtacaatgttggggcatgattaaagggcctttagcccccgttaaaggcactttgacctgatccagaaagtagtgggagaaccagcgaatgaacttagcaagaggaatgttgggtgcattgcagggcagccactatggctcaagttggggctttctgatgctttctgcttcagtctcgtggctgtctagtggtttgattttccattagccctttctcccttggccttaagggatggatatctacaaaatcttagctatcaggcaaaacctcactgtcccactggtgataagctgggcttcccagcagttcatacgaggcctgcatcctgctgtgtaacctgcctcaagactgcagaaggcagagttaggtgtccttccccctcagggccctctttatgcttctctggatttggtgccaaagaatccacagtttagggcaaccgtagaaaccccaggaggagtgtggtagcgtgtggagaccctactaagataaccatagccttagctgctccttgaggtctggctctgggtcccaggggctgcttagaaggatccttagtgatcccctggtcaggacatcatatgtttagagagcaaggttagaggagttaccacagttttcttctacatgctgattaatctaggatttaaatacaggctccaaaataaagtgtaagtggtggtagctcaaagaagcaaagcaagcttcacattaaatgacatgggcttctgaaaatgtgggaaggactaggaacacaggctacttactgcatctataactctctttagacaaagaaaatatgtgattaggaaatgttttggcaagatctcaccaagattatttactgcaaaggaggcccaggactcagcctggcagggaaaatggggcgggggggcgggagtgtttactgggagtatggaagagcattttaaagtatggaagtagattgaacccctgtgctggggctggggacagggagtaccataatacaattttatgctgttaggggatctctgcaaaacctagagtaagtagaggaaggagtctgtttgaaattaggaatagtagggtcagggtccagatggaggtggggaggagtggggctcagacctgaccactgcttctctaggcgtcgtttgaatatttaaagacaaagcacagtacatttgctattttattttattttatttcattttatttcatttcattttaaaccatggctaactcttctccagtcttctccaggagaaaaaacttgattgtcatcctggcacaaaaatgtccacagttaggctaacaggcaagcttccgtgagcagatcaaatttgctattctggttccaacatttaactccctagctttttttaaaagaaaaaataagctggcatcaactgaaatttcaggttaggggcttggtttgaggatgtttggggaagcgggagctttctgccatgtcttttgtggacattggatgtatttccgcattctggttggccacatttccccctggggcagattcttcagaatcatttgtctcccactgggagtctttttccctcccccccccccccacccccctttgtctttttctctgacatctgccgcacactctctccagggcatacggtccagaccctcctgggagagcttcatctgcttagtataacttctagcagaagatagaactgatggattttcgtgcgcaaatacagattcacaagggtgttcggtgtcacaagcatggatttatgatgcagtttgaaaagggtcagaatattcagagatgagattaatgccagcccatgagtgctttgtggtgctgaggtaactgaagtgcatctggtggtgtccagagctcaagtccccactgcagacgccaggaagaaagaggtggctcgcagactgagaaggggcgtagggatgcacccttcttgtctccttctgcttgataatttagatagaggatggcaggtgtaaatcagtttgtggtagatgcagtgtgagctgtcctttctcccccttcctcacgtccttacaagacacctgtctgctttgtatcgattccggcactgtgttatgatattcttgtagtttcatttttttgttgtttctcttttgatattggactttatatgcaaagaatgggattagtcataatctttacttcaaaacacattatcttcatatttttatgctggttgtgatggcacacacctgtagtctgagctactctggagactgaggtgggagaatcacttgagctcaggagttcgagtctgcagtgagctatgattgtaccaccgcaccctagccaggacaacggagcaagactctgtctctaaaaaagatagaatgggctgggcacggtggctcatgcgtgtaatcctagctctttgggaggctgaggcaggcagaccacttgaggtgcagttcaagaccagcctggccaacatggtgaaaccccatctctactaaaaatatgaaaattagccgggtgtggtggcgggcgccggtagtcccagctactcgggaggctgagccaggagaatcgcttgaacctgggaggcagaagttgcaggaagccaagattgtgccactgcactccagcctgggcgacagagtgagactctgtctctaaataaataaataaataaataaaattatataaaataaatagtgtaataaccaactatgtagtcacttcaggctgctataacaaaacacataaactgagtggcttataaacaacagaatttgattctttccgtctggaggctggtagtctgaggtcagggtgcccaaatggtcaaattctggtaagggccctctcctgggtttcaggctgctgacttctcactgtgtcctcacatggcagaagggcggggagctctctaaggcctcttttatacgaacctaaatcccatccatgagggctctaccctcatgacttaaaacaccttctagaggccccatctctaaataccatcacattgagagttaggatttcaacatacgaattctggggtaacacaaaccttgtctgtagcagtgaccataaacccatccccccagacaaatctaggacctggagcataacctgcgtctgagcagattgccatccttcccacacctcctctcccttcttttctctacccaaggtaactattatctgaaccctgtatacatctatgtttccttttctgcatactttatttcgcttacatatcgttctaaaatggaacacataaaaacataagacatacacacataaaaagtatgtagctatatagatatgtatttaattgttatcacctttcaactttataaaaaggatatcagaccatatataatcttttgggacttacttttttacttaacgtctcgactgccagcattcatgtgtattgctatgcatcacggtagttaatttgccttgtctgctgtatgatgttccatcatgagccgattatacacagtttattcattcactctctcattgatgggcgttgaagttggtgctaggatcttggcaattgcaaacaggtttgccataaatatattcatgtatgtataatcagttgtccacgtgcaaaagagagtcctttgtgttcgtgactccattattttgaaaccagcagtagtactgcacactgggagaatgtttgtgggaagcacaataaaggtaagtcctcagtactttgtatttcagtttggtgtgaagaagtagcatgtagacttcataggagacaagacacttctatggtttgagtatttgtctcctccaaaattcatgttgaaacttaatgccttaatccccggtatggcagtattgacacatggggcctttaagaggtggttgggtcatgagggttctgccctcatgaatagattaccccattcatgggttaatggattaatggattaatgggttattatgggaatgggactggtggctttataagaagaggaagagagacctgagctagcatgctctgccccttaccttgtgttaccctgcactgtcctggaactctgctgagtccctcctagcgtgaaagccctctccagatggggccccttgaccttggactccctagcctccataactgtaagaaataaatttcatttctttgtaaattacctagttttagggatttggttataagcaacagaagacggactacatatcttattttaattttgttcctcccactaacttcccagccccacagtgcttggagcaactgtttctgcagtcatgacttcagtacagttaatgcctgttgacttcatcttatgttaaattctttgcaggtaaagccatgttccttataagatcagtctttttttgttcctctatgtgtctaatcaggtcaattctttgcattattttatttagcatcatctaccaggaactaggcaggcattgtcttaataaagcctggttcttgcagttggagaacttgctatctagctgggagaggcagtatgcaaactaagatttagaatgcgttatgaggccaggcgtggtggttcacgcctgtaatcgcagcactgggaggctgaggcggatggattgcctgagcccaggagttcaagaccagcctgggcaacatgacgaagccatctctacaaaaaattagccaggcatggtggcacatgcctgtggtcctagctacccgggaggctaaggtgggagaatcacctgagcccaggaggttgaggctgcagtgagctgtgattgcaccactgcactctagcctgggcgacaggatgagaccctgtttcaagaatagtaataataataaatttaaaaataaaatagaatgcattattatatgtaccttagaacttaggtcttagagagtgcctacctctccttgggagagaagacttacggtggtgggagacagtgttgcatctgtcagataaattagggaaggcacatggggcggacgatttcagagaagttaaaggcatgggagaacatttgccacgcaggccgtggcaagtggttggctttgactgtaacatgcagcgtatgcagttcctggaggcagatgagggaagtcatgcagtacttgtgtttctgtgagtctcttcagttttggggtttgtagacaggtcatgttcacttactcctaacctgtctcccacaatagtcatctgggtctgtgctacttagtgtcatcctctcactctttcccttggtggcatatccagttggctaagaggacaggcctgaccttgtgcccagagtagggagaagatcccgatcacctctggtccttgtcaggctgtttgcttggatggtagagttcacccaagttcggactcaggaacggcctgtggtcatggagtagtttttttctgtccagggtctggaccaagataactccatcacaggggtagcaacagtatgtgctggggcaattctgctacccacttctggtgtccttcagtgctttccctgcactatctctgtccccagctgcttccatccatttgctttctagtgatgaagcactgggggaagctgcagggatggctgctgcacccacatccatccctgcccatctgttctcagagactctatggctagcagagggagtgatgatttcagggaagagtaccagagagggccagtgggtagcaggagtctcacttcttggagaaaacagctggtcctctgtgaccaattctccctcaaactagggagattatatggccactgcatacacaaacacacatgcttgcgaagataggatggagttgtaccaaataaaaagtttattgaaagggatggtggtagagaaacactgtatcatgccgtggcataacagggtattatatgttggatggctttttggaaatcattttaggccaaccttattagagatctaatttatttgtattcttgtagctacctagcacagtggtaagaacacagaccaacatttggtaaaccttggtttgaactctacccctgctgcttctgacctctgtgagtctgcatattatttaacccctgaggctcagtgtcctcggttgaaaaatgggccactaatttagtataagggctatgtaagatgtaatgcacatgacatgttttataatagcttcttatggaattatctgaattggggacccatctgttgcttttataaaaagttcaccccttaagacaagtcagtccaatggccatgtttaaaccaaatgtactgtcttctgtaatgctcaatatatttttcatgtcattgagtgcagagactaggtgggaagatgatcatatacagacagaatgggcaccactctgcctaaacatggctctcgctttcaaaacagtactttaaaatatctcctccctattaaacttttccagtgaagactctttttccacctggttattgtctctgtgtttgttacagccttctctctgctttcagatattcaactctgcaaagtcgtaatcatttatccacatgtacttttgtgtgtgtttgtcccatctctctctttagaagacatgttcctgctggtgcttggaataagacgttcttttccctccccgtggagatgctatttttcctctctttaaggagctaggagagaatttggttcaacatgtcttatgtatcagtttagcactgtgcttttcttcccttagattgacgtgtgatttaaaaaaacaaaatttggaaccggtcatgtaaagatggtgtatgtcacttagtataggtcatctctgtaccctttgtatactgaattttgctgtgacctgtcaaaggataccgaagacaggcccatgcgaaacatttaatttctggcattttcgtgcatgtgagactcatctgatgtgaactgaaggtatgttatccttccttttaatgataccaaatctggcccaaattcatatgaccccttagaaaattactgtgataggaacagattctaatgaattgaaatagagatttctccacctcacgtaattaggatttgagagttaaataagaaagtcagggatagggacagggatagaatggcatggagaaagttggagccaagaacactgaggaaaagaagggagtgacagcagcaaggaccattgctgttaggaagggaattctttcatcagacactggaattctcctgccaggcactggagtttgccctagcttctgtctgcttttactggatcctgggtcctccagctgaagtgagttgtattacaatcccttccagttttgcacttcagggaagtgaaatggagcaaatcctaatggcacaggctggagggagaaggactagtttctttaatgtgactcaacacctggcaaggctgtctttttctcaaccgggtttcatctgttagttctgcaacatgcagagtcagattttgaggagtttccagctctcgccttcatggctgtccttgtgtttgtgtttgtgttctccaggcgcctccttctccactctttctccagtgctggagacctaggggtgtgcatcctggaggattgtgaggaacctcagctgctcccctcgtcctctgaccaggcggtgggctcagggagctttggagtctcatgcggtcagcagcgcttagcatgttcagttggctttttccatatcaccagtgacatctttcttcttcctaatcatcgactcatggaatattagaattaccaagcctcttgcagttcctgtggtctaattccttcattttagagatgaggacccctaaggcctggggaggggagatgataggtgtagggaaaaaaaaaagaaactttttcctctaaataagattagcaaaacgataaattaacaggagaaaaatagagagtttattaacacgtgcagcacacatcacacaggagaaacctcagtgatgagtaactcaaagtttcaagagtttttatttcttttttctgtatagcacttgtcagtctctgatattgatttttacttgtttcttaatgtttgttctccttccactagtacgtacactccatgggaacagtgattttcatctgtttgtcactgctttattcccagcacatagagctgtgcctagagtggtaggcagatcattgttaaaacaatgaatacatgaacttcgggcaagttacttaaccattctgtacttcagttttcttgtgagtaaaatagggattaaaatagtgcctacttcatggagttgcaataaaaactaagggagttaatccatctaaagtaccaataacccacctggcccatagtaaatgctcaataaataggttcccagccaggcgcagtggctcacacctgtaatcccagcatttgagaagccgaggcaagaggatcacttgagtcaggagttcgataccagcctgggcaagtggtgaaaccccatctcaactaaagatacaaaaattagctgggtatggtagcaggggcctgtaaacccagctattcaggaggctgaggcagaagaattgcctgaacccgggagatggaggttgcagtgagctgagatcatgccactgcactttagcctgggcaacagagtataagactctgtctcaaaaaaataataataaaaataaataagttccttattataattactaaatattgtatttcctcactagaatgcaaactccttgagggcagagactatttcttacatcatctttttatttctagtagcaatttggctgacacatgattgatattcagtgtttgttgaacagatagataagttatagaaaaattgtaggtaatacttctgtaaataattgttaaatttaaatgaatagatttccttcctgtctttttccctaagctgcaatcagtgaatctacatggattacatagattgtgactacactgtgccttaactcatcacttaggcagtggagtcgatcatttattttgttgccatgacttggctgaaatttcttggggactgacagcaatggcagaaacttgatgggtcctgaatgtcaccatagcctgtaagctacacaggagccacccgagaactcctccattcgtggttgtaacttcacagaaatgcttcccagtcagaggaggtacttagcagaggctgcaggcatctgaacagacaggtgcaggaaaagttgaaagggaaggttaagggagaaacatactcctcatctccgttctcaagaaacggcttaaaggttgtaaaaggattctgcttttaagcttgagtcactcatttgacttctgtgggccttgcaatttctctggtaaaattagagaatatgaccaagattatctccaaggacctgtcttactttttaagtttcctaattctgtgaaaaatgcttaagaaggcctcagactgattaagaatttaggggtgtaagtttaagtggggatactgataaaagggcaggggatgttactgtaagagcaatggaaaagtgtctgagtagtgtagcatatccatttgtgagaggagtaattaattaaaaaatgaaggcagaatccacatcttcacaaaagtttcctatctcctggtttggatgagtgtatttaatgtgaactaagttgcatgtgggctgtctaatctgggcatctgacttgtgaatccttcccataactaagccccgagagatttccaatcatgcccataaggtaatgcaatttggcaagaggatttggacttgacgaaatctcttgttctatttggcatccagaaaaggctgacttgcctaatttgaaaataaattgaaaacaaaaaaaatttaaaaaaacctctggttgttccttgtttgatgaaataccatagaaaactattactctttttccataccccattactatggagaatatgtttttaccactgactcttctaagtatctgtccttagtttcctgtccttccctgccacaggttccaggaaggctgaatcactacagcatggtattaaatcatagaaatacgtgtgtattttgtaccatgtgggtctgcttgcattcctaacatctgcattagtattagttttctattgctgcataacaaactgccacaaatttagtggtttaaaacaacattcatttcttatctcagtttctttgggtcaagaatctggacacagtttacctgggtcatctgcaaagggtctcagaaggctgtaattaatgtgttagccagggctgtgttctgatctgaggcttgactgaggaagaacccactttgttagcagaatttagtaccttgtggttgtaggacagaggattttagtttcttactagctgttggttggaggcttccctctgttccatactatgtgggcctcccaacctagacacccacaacatggcagcctgctccttcaacaactagcaagggagtttaatgttttcctgtagctcatatttctttataggtgtgacctcaatttttcccctaatacctttgtaagatagaagtagggagaaccaagatagatccaaaaaggctgaatgaaatgcctgagattgagctggtggttgcattgaacaatataaattgatgaataacaatttattaattgtgccaggcactgtgctaagagcttcatgtcagtacattcttgtttagttcttagcacaaccctctgagttaggtattactactactaaactatttaacaggtagggaagttggggattagagaggttatgtaacctgcctaaagttcacagacagaaagtgcacagcccagatttgaacacaggcagattccagaacccactatcatcgcactctgaagatctctccattagagcacgatgctgccatgttcaggattcttcctatcttttgttaaatacttaagttcctgcaatattgcaaagggataattgtaataggttgcccctttcaaagtgctttaataaaatgaaaggacaacattctttcttttctgcttgagccaggctttctcatttttctgaagacatctaggataaatggaaggaaaccagaatttagtggggtttgcatgtattgataacagttttgctgaatacacatccaagagctaaaacatgcaaactcttcaaaattggtagaatacagcttgctcattttaattcatttaaaaatgttcattttaattaagcattacccattttattattccataaaacacgaatcatctggaaaaggcagcataggtctatttttccagcctataaaactatatgtagatggatcttgatgagggatgtacaagatttaattagaaactgaaattttagagtaaaaaaatgcaggggtgtgtgtgtttcttctatatttgtggaaacccaaagagctatcctgcaggatacttgaaaatatatataaatacagaggagaaataaagtgcggagaaggtttgttgattattgagctttttcatgggtgatagaatggagcagctgtaggatggaggtaaagaggataggaaaatgctcttctgggtcagacccagccccacatcccaaaatgttgtggccaccctctgtgttatgtaaaatgtaggaaggtcctcccagctggaggaccttcgagtatactgcgttccccctcctcattcactagggaggatgcaaaggtgcaaatgggccaaggtcatgcattggacttccttcattaaactgttatgaatttgccttccctgagctcctgttggaaaaatgtcttgaacttactgttgttgtttctcctactgcgtttgtatttctttttataaaccttagtccaagtcagcccagtgctgtagttatttgtgtatctgtgtcattctccctaggatgccctgggccatttttaatcaactttgatcccctttcagtgccttgcatgaggcctggaacattggaggtacacactgtgtattgactgaatcgagtgaaaggtatttgaatatacagttgactcttgagctacatgggggttaggttgctgacccctcacgcaggaaaaatatctgtgtataactttttaaaaaataaatttgggggtacaagtgcagttttgttacatggatatattgtgtagtggtgaagtctgggcttttaatatagccttcaccctagtagtgaacattgtacccaataggtaggttttcaaccttaacctgcctcctatctttggagtctccaatatatgttatttccctctgtatgttcctgtatacccattctttagctcctgcttataagtgagaacatgcaatatcttactttctgtttctgagttatgtatataacttctgagtccccaaaaacataactactaatagcctactgctgactagaagctttaccgataacgtaaatggttaattaacacatattttgtttgttatatgtattatatactatattcttatagtacagtaagctaaagaaaagaaaatgctattaagaaaatcataggagaaaatatatttaccgttcattaagtggaagtggagcatcataaaggtcttcatcttcatcatcttcatgttgagtaggctgaagagggcttggtcttgctgtctcagggtggcagaggtggaagatgcggaggaggcgggaggaaaggcaggccactcagtgtaaatttactgaaaaaaattcacatataagtggacacacgcagctcaaacatgctgttcgagggtccactgtatttcatctgtttgtttcctactgtggaagacagggcttccaggctttagttctaaaacttccattgtaaggccttgaggaggatcctctcattccagtaatctgagagttggtaaacaaattcaaagccactgtatcactgtcctttatgtccctatgttttttttttttacttttttttgccatttcttttttcttttgcactttaaaaatcgtggtaatatatacataatataaaatttgcccttttaaccattttaagtatacaattcagtagcattaggtacattcacattgttgtgcaaccatcagcgctctccagaacttttacatcgtccccagctgaaactctgtccccagcaaacgctggcatgcccttctcccctcccccagcccctggtaatcaggggtcttcttcctgtttgtgaattatgactactccaggtctctccgtaagtggaatctcatttgaccttttgtgactggcttatttcacttagcatgatgttaaaaggtttatccatgttgtagcatgtgtcagaatttcattcctttttggcagccattgtcttaagactcaagagtttaagtgtttttagtctctgtagccagaggtagatttttcttccagctctgtgcttgggcatttcccaaagcgaaacttccaaaggcacatcctgtcttcctgagtggtattctttgaggcagctgagtagcaaaactgaggctattaatgttcgcttagcaactgagcagctactgtgtatcaggggctctgcctgtgaccagggagtacacggtcttgtagaagagaaaaccgggtactcagctaactgtggtaccatgtgctaggtgccaaaggaggaacagagggccctgcgtgatctgctcaggaccgtgagggagaggtaagaagagttcaaaggagaggtcatatttcaaacagaccttgaagctgttcaaggcagagaagaaaaggatggtgttccacgaatggcctgagctaaggcaagtggaaacacgaggtttgttggaagaatcgcaaggacagcctgatgtttatagaaagtggagagagtgtggggaatgacattagggcgtatatgaatgccatgctaaggattggggtacaggtaacttggaggcctcatgcagttagactgaccccgttcgatctgtgggttgacaggggggtgtgaatggattggaatgggagagaccactgtgtggggcaaatgggaagggagcgtggttgcagcattttaggccagagatggtgagggcctgaagcaaggcagtgagagagaagaatttgctcatggtcaggtgcatcgggcctgttgacagcagagtttgttggactgctcccacctattgctttttgtcttctgaagtttttataatttcaattccagtttagaggtctgtttttagaacatttctccgatcttattatacccatagtggcaagaatgaattgatttgtacaagatagctggacaggttcctaccttcaggctttctacccaactgggcacttggaaggatagtttttcatagtcttcatgggctaagtgattgcatgtaatatacaatagctggagtctaactgtaattaaaacaggttagccaagctacaggagaagtatcccccccatccccacccccatggcccttccccactgcctgtaatctcttggtaacaaaagaagtcaaacaaaaatttcatgcaagggtataaacatactttgagtcatcagaacctacctagtggtccatagaaccttggctcttcatgaagggcttaccaggaagacatagtcgttgttcatatgcagtttctattctgaactgtaaaatgtgagcgattactttggaaaattagaagaaaaaatgaatttactcaggatccttaaaaggttacatttgtcatgcctgtaatcccaacaattttggaggctgagccgggtagatcgcttgagcccaggagtttaagaccagcctgggcaacatggcaaaaccctgttgatacaaaaaatacaaaaattagctgggcgtggtggcacatgcctgtagtcccggctacctgaaaggctgaggtgggaggatgacctgagtccggagaggttgaggctgcagtgagtcaagatcgtgccactgcaccccagcctgggtgacagagtgagacctcctctggaagaaaacaaacaagtgacatttataggagggtcccaaacatacaaatatggaaagtgaaaatactacttgctacaggtactgaaagaaaatactcaggagtcattattcaactgaaagcagattgaggcaaaggtgctgaaatatactaaaaataatgagtttcaaagaaaatcatcttttgttaacctttgcattagtcagtccttattttttcgttttagtcactcctttacaacaatgtgtataaatatagaagatgaagagaagtgtgataaaaataatttaagatttggaacatgggttttcaaaggaaaggttagagaaatttggggattaaaatggacagactttatcatcttcaatattaaaaaaaaaaacagaaggatatttacgagcaagccaatgaaatgataccaagaagtttataacacatactctgcccttatggggctttcacctagcggccatgtttccattgtgcagttaactactcagttattttttatttcccaagagcactaagtgaaagcaaatgcatgttaagtcgtgggggctattctgaatgatcaatagagcccaccagagtcccttataactaactacccattagcagatgtggagtttccttcttggggatggaggggactgagtcggggagcttcctggatgggagtttgaaccaaataatcttaattatgtaattcctttcaattttaagatttgagggcaactttagaaagagataagtaattgactgaccaactttataaagagatcagtaattgaccacccttggagtgtaagagtcaacacctaaaataaatgtatatttctaatattttgaaaatagaagaaaaaggaagaaaggaggaaagacaagttatctagtggagacgatgaattttcaggtcatccttctagtttttattttagacttgtgtctttagttgaaattattacaacttgcatgtattttgtctgtttactcattatttcgtctgtctcaccgttccaaggtaagcaccgtgaaaacggactgtgtctttttagttctttactgtgtttctgccatcaagcccagtgttgacacatggtaggtactcaagacatgctggctgaatgaatcagtgagtagtgaaggtggatcatggggagaagagtgctgcaaataccagagagaaggagaagaaggaagtggaggggatagcggaagaaggggaagaggagtgagtttacaaggcctttttttctttttttgacagagtctcactctgttgcccaggctggaatacagtggcgtgatctcagctcactgcaacctctgcctcccaggtttaagcgattctcctgtcccagcctcccgagcagctgggattacaggtgcacgccaccacaaccggctaatttttgtatttttagtagagatgggatttcaccatgttggccaggctagtctcaaactcctaacctcaagtgttccgcccaccttggcctctcccttgctgggattacaggtgtgagccaccatgcccagcctccaagccctttcttttaaaaaataaattttattgtttatatttgagatttacaacatgatattatgggatacatatagctaatagaatgggttgctatagtgaggtaggcaaccattctcacaggggtttgtgtgtgtgtgtgtgtgtgtgggacaagaacaactaaaatctacatatttaacaaaaattcctaatagaatatagttttattaagccttaaaaaaggagatcttgccatttgccacaacatggatagacctagaggacattatgataagtgacataagccagatacagaaagaaacatattgtatgatctcacttttatctgaaatatttattttaaaagctcaaatacagagacagagaatgaaacagtggttaatgccggtggaaatggggagatgtgggtcaaaggacacaaaatggcaagtgcacaggatgagcgtgtctagagacttaatgtacaacgcaaagactaaagttaacaaggccttttggttctgttgctgttgttgcattacgtaatagtgtgctaagaacaggagacacataacgtcatctaaaaaacaggagatgaagtgggccggtgctcaaacatgctagctccgggaaacaattcaggatgatttgccactgagtcaggtttgttaattttttctacaatagccaaaggctctcaaaaaatcaaggtttcctggtttataaataatctctggaggggtgtgtgtgtttcaggcatctgactcctttatttatattctctgccctggccttcagatgattttcgagcggctttcgattagattatctgcattgggataatggagcaattttgcagcaaactgctttggactgttcgactcttctcggcctgagtagccaaaaaataataataacttgatttagtctggtctagcctgctgtagtctgacttaaggatataatatcccagaccttagacacttgacttaatacattaacatattaacaaaagggtaaaacaaaatactagaagaaaacataataaaaacagcacattatttttcgggcatttgacttgaaccacagggtgccctcataatgaaaagaatattccaagggaaagatgagaaggcaattgagacaaccctaagcccctgtctgcccactcaaaccctctggccaccactgtactctctccaccatgagaaagcaggccaggagtcagttcagctgcctgtgtttaagtgcttttaatatccatggaggcacagagaaatgaaagcaggagccttgaatctagatttttccagaatccttttgagagacttattgtagcggcaggagctccattttgggggggtcaccccctgaactttgatggttttcaaatctttggagggccttggtcttagtggctcagaggtcccctgccaggacttctttaggatggggatgataggaagcgaacgttccttctgttgaggtgcatcagccttgcatctgagttcttgatgtcctcaggcctggcttcccagttggttaaaggaatgaaaataacaacgcctttcatttgcagtgcagctttaaaaatatttgcttttgctatctcattttatcctgataataaccgtgtgagaaaagcaggatggcagtcttactgtccttgtacacatggagaaatagatgcacagaggttaagttgcccagtttagtaaagggcagagcagggactagactccatttctcttcgctggaagagcccagcactatcacattgcaagattgtttcttgtaaaacagtcctgcataaaaataaaaaagagtagagagcatgatgtgaatttcagcttttagaggctgctgtctgtttttcataggttaaatagtgaatcagtgtgctccgagcttccatgaggggcagccctccttacctggcaggttactgagttttctaatgacttcagttttaggtgctaggagatagtagggccacctgcactgttttgtgagcaggacagataagaggcaagtggagagggtgggagagcactggcttgcatcatacaccccagctgcccttgcagggcccgactgttacaagccaggtatttctaggacgattgcattcctagccatatctgttttctttcagatggggcgtacaatttaccttttgagttctgtaaatggaatcgaggtgaaatctttactctggtgcacatatgacctgcaggttgatgctgcttgtttggaaagccctctacttcacagcgaacagtttgtactgtcaggtagacctctctgccaggggaccaactcctgtgtatttgaaaaggaagacaaacctgtattttgtagaaagggtctattgttcccagggggtggttgtggccaacttcttggactcctttggctgactctgaagaaggaattgaagtcagaatgctaatcactgacttgcacaggcctcaacaatcaaacctcagggaactcagaagaaagtaaacaagagcgctcaattgcagagtcttgaagaagagcagctgtgtaaaggaggctagacgtgaaaaaaacgtgttggagaggaaaaaaaatcacattccctgcttctcaaatgggaagtcttaaaaataataaagaatcctgagcagcgggctcatttcccatgagcaggcttgctgtggcaggcaggctcacctgctagaggtggtctcctggcttagaatgggagcacacctgtgggaatcgcagcgcttctctacctgagctggatgtagattgtttgaaaatcctagttgtgcactgcgtttccatcgatccctttcatgctcccacttgttcctttagttccaaatagcaggctggtgttgagaattctgtcatcatggggcgtttttttctaaatgtgagaaatgtcggaagcatgggtgttctcagattgctttagccactgatgattttccttttagtgtatggaaagaatgattttcttctcaatttctcccctctaacctcctgcatgtagatttatggattctaatcgggacctttctttgattcagtgccaggtacacaggccccgagtcgtatgtggcaagtggccaaggggatcggtcctggagaacgtcatggcacacaggcattggccatggagtggtgatccctggctctggttcttctccgtccagtgacctggcatgtcacctcacagggccatatttacctgttaactgagaaactgaactagaacatggttatgataattttaatctcaactttgtctcctcctatcttatggcagtaaagtgaccttttagcaggatcaatttataagccgtttgaagtctatcttttcttcccttagcagttgtatttgtgattttctcagcctgattttaagttattctgttataattttgaatgttctgttatgcttccctctgtggtgagcatacgtcgaaagctgtacatttccttcagggtaacctttgtttccaacaggagagagttctcactaccacatccagccttgatctctttaacctaaattggaataagccagacagagctggggttcatgggacagatgggagcatctcaagtttagggttggggagtctcagtgaaaaaaaaaaaaaaaagaacaagaatgtagacttggaatttgagaacagataaagcagtcctcacttgtgctctgcaagggagtgctgttgtcttctaaggtattgaacagactgggtgggaagctgctgaaagactggaaatttggggacttagcaagaagtataatggtgctgtaactgcgttttcttaaggaaacttggagctgaggtgccacctccctgggagggacttttccactggtttcttgcagtctggacatcacagacggcccagactcccccctgtcttgtgtacattcccttctacaagccttgctgtgttatcacaggtaccacttgtaggccagtatcatgggggatggacattgtttcattctaggcacattcaggaatcgtatatgtaccctgcctcgcttctgacctctcaagtcaacttttggagctgttagtgacttccagaaagctgacacccagtgccactcaaccaaccctgcttttctgctggtttatttttgttattcctaccccgactcatcttgcttttcagccatcaatgagaatttattgagttactcagacactcactcagaccctgtgggagagtagaaagatgtgtaagaaactgtcccagaattttgagggacttaaaatccattcgaaaaggcaaggtctaagcacatgaaaagttacctagcaatatcagctcatgaatggagagacagttgatcagagaaagagaaatgtctgttcaggagtggtcaggggaggctgcattgaggtgatgcacacgtgtggcctgaaagcttgattcgttccccaccccccattgtattctatatgtaatatttgatatataaccaagaagctatgtgagttacaaagcatgatgatacagtgaacacctatgaactcaccacccaacataagaaccaaaatgactgatattgataccctacctatatacctctaccttcttcctcattctacccctgccctcttatcccagttagccactgtcttaaattttacagattttattccgttcctttttttcttttttgaaagcgtttgatcttttcttctctcctcctctcctctcctctcctctcttcttcttttctttcttttcgagatgaggtctcgctatgttgtgcaggctggtctggaactcctgagctcaaatgatcctcccaccttaacctcccaatagctgagaatataggcctgtaccactgcacctggctagatctcatgttttctttggaaatctagtaattgtgatataggatctctgaatgcagaacacctagggcacaagtgatgcttaattttatgtgtcaacttagatgggccacagtgctcatatgtatgatcagatattcttctggatgtttctgtgaaggtatttatggatgagactaatatttaaattggtggactttgagtaaagcacatggccctccgtaatgcgggtaggcctcacccaatcagttgaaggcctgaatagaaccgaagagggaatgccacagcagatggccttcagacttacactgcaccaccggctcttctctgggtctccagcctgctggcacatcttgcagattttgggcttgtctgcctctataagcacataagccagttccttaaaataaatatctgtgtgtgtgtatgcatttatatatacacacaccaccctattggttcactttctctggagaaccctgactaatacagcatatcacacctctctgtatgccacgtaggtagcactgcagaattaatttgcagagtattctcacatcgggaggtcagcagtatattaggcgcatatcagaaaggcatttggatgattctggcctacaccatggaagagaaaccttgattttctgtaaaagcaaggccagctttttttggagaactcttttctcccttttagtattctgtcccctcccaaagctccgtggctttctctggtcattcagagaccgttattccctccccagcatacatgcacactcatgtctatggtttcccgtaccttctctgtggagccctggttctgcctgttacaaggaaaggcatttagtttctctgacctcctgtctcctcagatgtcagtctgtatttattatgtgtcaccatgtactagatactgatttaagtgctttgcctgtttattccatggtattttcacaacaatcccaggtggtaactactatcatcttgttcattttgcagtgagaaaatggcaagaaagtcatagaaatgggatttgagtcctggtagtccgactttagagcgcttgcttctgacgcttctgaaacacattatgaactggaaattgctctacaaatatacactactgttagtatcacaatgctagtattatagtgcgcctattgccttggggccctgcgctctgctagttgatagctagggcatttttggagctgatgcaggctaatgagggtcgttgataggaaagtattgcttttcctagaaagctctggttctttgacagaagccttctggtggccacagttcctgagccctaagaagaaatcctgtagggtacctctaggacatgatggttagtgtagggtcatgagtctgctctctggtcatgtcaagaaagctgccccctactttgtgtttaagcagatcctggaggctgcaggatagcccattgagactaagtggagaccaggcatcaggtgaggaagccttagcttggagggtcagaggcctcagctagacttggtaaatatttggcacttcctctccctcacaggaccacagcaaatgttaaataatcacagcactctttagtttgaccaccactaatcgattgagttgggcaaatagcatggaaggtctttgcctattctttgggagctctgggtgtccccagagaattgagtctggcattaagttttgcctctcctttctcgttttcttttcccagccatatttctccaggttttcagcacaaactcaacccgttatttttgtttcttcagtgtctttaactctttccctgcctgttgagatggagtctcactcagttgtttagtaatggcagtacatcgagaagaccatcacacagcaagagttctaggagtttctttgcctgtgaggttagttttctatatttcatttgtggagggaacagaagtgatcccatttaagtgtggaaactttctttttggaacattttccttcctttttcttcatacatcgtggttccttctctcctgcactctcacatagataccagtatatagagatactgtttctaatcctgaaattccttttttgaagaaaagagaacattgtgtgccattgttttctgcgggagatctatgctgcgcttctgttttccaaacatttatccttaaagcattttcagatgtcagttaaacaagggagcaatggcccctgggtcctgttagggacatactcttaatgactgtaaaatgaataaggtatagaggaatattcgtctgaagtcatgatttgtacgtcatttccttgctttcttcaacatcattatttctgaaccagaaagtattttgatcaacattttggaggaagaattgtatggtatttcccaaccttccccccgtgggtggaattgcatcactgaatcacttttctctatttttttccactttctgtctcctgttttgtcaaggctccagcaaactccagccttttttctgtgttttttagtcctaaaattctagcctggcatctgcgattgtgttagtttcccatcattattttctagcctaacaaggaagcctcgtgaaaacaaagcgttctgtttaatcctcaggtggacgtttgaaccctcgtaaacatgctcccttcacccccccatcttactttttagcaatctcagagatcaaaaagacagtcatctcatccagtgtagacaaagtgaagtacattcctttcatttgcctttgctgtagtccctatttcatccatctaatccgttttaagggataaaattgcaattacaaacatttcatgtgtggtcagatttttagtattttaatctggtctgagacttaagatgaaatgacagttctaacagaggtcctgtgtggaagaaaggacctaggtgccagtctcagtccagtcccttcttagacgtgtgactttggaaaacctctcagagacccatcatctcgtcgtagatggggatggtattacaggtcgtgctcatctgtgttaatcagggttctccagagaaacagaaccaataggagatccacatcgctgttgatgtcaatagatagataggtgtgtatgtagggatggcaggctggagaccctgggaagagttgatgttgcagtcaggaggctgaacttcctcttccttgggagacccaagtttttttctcttaaggccttcaactgattggttgaggcccacccatattatggagggcaatctgcttcactcagagtctactgacttaaatgtccatctcatctaaacggtatcttcacggtgttcaggcaaatatcggtgccacgtcctagtcaagttgacacctgaaatcaaccatccccctcgcaggagtttgtgagcatcaggtgtgaatggtcaggagctgcaggcgtgcacggaggaggccactgttcttcatgcttgagccttttctgtttctgcctcgtttactttccttctctctcctcactgttacccttttcctcctacctctgacacctgcccttcacctcccacctgctacctgagatgggagccacacgtgaagtgagaagaagggagaatgaccaggtgggtgatgaatttaaactggaaagagaacagatcctgatgccagtcaggatagaggtggtctagctcttatgtgatcatgggcaagtgaacatgcctcagtgagcctctgatcagtttctgtatgaggataattatatttatcctctaaaatgaggataatgatatttatctgatacagttcttctgccctaacacatacgtgtgcattgcctttgctttcaaatgtttggtaatcacctttttagatttaaatcattactcaaattgaactctccttcagcctttgtgtgtctagactttccgttaagattagattacttgttttactatgattgtaaaccattgtttccatgaagtctcatagcaaatgttcttttgctttcctcttttgttactagtctcttgttatttctcaaacatatcaagcgcacttctccctcagggcctttgcgtgtgctgtttcctctacatggagctcagatgactgcatgtctttttcctaaacttctttgaggtgtctgttcaaatgtcttccactcaggggggctttccctgagcaccttatagaaaataaataaaatgatataatatctgctctcacgttctgttgcacttgccttgctttgtttttcttcatagtctttatctggaatatatatttatttctgtctacatcctcccactaggacagtggttcttaaccttggatgttcattagaatcaccctgggagtttaaaaaaatcctctcctgtgttctagaacaattaaattcagtaatgttataaggaagagactcagcattagtattttgtaaaactcccaggagattcctatgtgcaaccaagcttgagaaccagtgttctagtctagaaccttacttcccagaggatgtggactggtggcatcagcatcacctttatttgaaagctgagtccaattcttctctttggcaggacccacagatgatgcatatgacattaaagcttgagatgcactgcactagaatgcaggggcgtcattttgcttgctgctgtatccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagcctcaagaggctgagaaccaaagacggaaaaagcacaacttatagtccagctatagagacagacttttaggtaagtaatcataccttgaggtgaaaaaaaaaaaaaaaaaaaaaaagatctgtgatggaagacacttacagacatgtagacagggtggtgtggaaggtctacagtaagtgactgtttcagactgaggggagggagtagactcctggtgaggagggcaggggcatgtgagttgcgtatgtgagtggctggaacacaaggtggggaggcatgcttgtgtgctttggcaatcacaaagacggttagaaggcagttaaagggttggagtatggtcagttctgtgttttgaagagatgactgacagtcgtggaaggtggattggagaaggaagaccatgggcccatcacacccagtttggagatgattaaagatgatacccacgttacatgacagagccgtggcaggggcaataggatgtaaaatgtggagatcgttttgagatttttcaaatggggaagaccatgtcttttttgtttaaccgaaatgagcaggaattcttggggtgacatcaaattcgatagttctatgagcatatacactgaaaaccacgatattacggaaatataggctatttctcttttcactggcctttagatagactggattagtggagagttgagcattcgtcttttcttagagccttgagtggagatggaccctagtgattatttattttgactgctttattttgaagatgaagagaaggaggccaaggtatgaaatgattatcagaaccaggaatgcaacttgaggtcaccattactagatacatagtgagtgccaggtggtttaaatactcattatcaccttcaatcctcacaaccattgtatgaaacagggatgctatgtttattttagggatgagaaaacccaaaactcaaggaggtaactcacccaaggttttgcagctagtaagtggtacagctgggatccaaacccaggtgtgtcccagctacgctgtgccatctactcctctgccctgctgctttcctaatcagtactccctgatgctgctgaggaagagtcgaacttatagaggtcacacattgttttccttgtttttggatgcagttttgttttctttgataatcataaattgaggatttatgacagccgatttctctctgttattttggtcacaatttcacaatgtgacctttggaagtaagggctttgagttccttaaaatagctaaattgagaggataaaggaaaactgactcaaatcagagaatttgcatcaggtttctgtaggtttcttataataatcaacaagtatttagcaattcttttttcacataaatagaagagccaagagaagaacagcgtctttgacctgatggtgttaagcctgcaatctgggtaaaaaggaatttgcggaacactctggatctgatactgaaaagttgaagaaagcaacatcttgcttattacccttgtgtttaagaccatttggggccgggcgcggtggctgacgcctgtaatcccaacactttgggaggccgaggcgggtggatcacgaggtcgggagatcaagaccatcctggctaacatgaaaattagccgggcatggtggtgggcgcctgtagtcccagctactcgggaggctgaggcaggagaatagcgtgaatctgggaggctgagcttgcagtgagcggagatcatgccactgcactccagcctgggcgacagagcaagactccttctcaaaaaaaaaaaaaaaaaaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcaaagactccttatctcttagatctaaaatcattaggtagattttgattccaagggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggattcagacagagtgtagtaacaagcaggggtgctatggaatattcatttatcctaaataaatatctttttggcaactgcttttccctatagtgtaatacagtaacgctatggggcatgtatacatgtgtgtgcataaggaacatccgtccatctctagctgtcatgtctgagaacattaataaaaggctcgacctcatgcgcctgcaagtgatcacaagacagttactgaagcattcaaagaagcaatgtctttgtcatctgactcattttgaaaacgcatgagaatgctttcccaaggcaatttcttacaaaatacaccgtgggacatttttcctatagtttattgttgttgatgatcatcgagaactttgtacccagagacactctacactgtgagtgtcccctgatattccctcccactcagcctgatcagtggtatctgacctccaactactcgctgcaacaacccgttctctagctgagtgggcctggactttgaacagaattaacagcctggaagtggagttctcaatctcaacagccccttacctcatgcaaatttcttttgagctgaaaagaacaaacagaatgccaccttttaaaacaaccttcttcgaaacatggggggaaagtcaggttttatataaatcagagagatagaaataaggcccataataaaaaacttgaaatagatttgggaagtttccgaaacttccaaaaactagtggtccaaagtgggcaatattttttgtgtgcattgagaggcccttcctgtttccttggtccatgctggtgtcttgccccgttccaggaaccctgggctcccctgtgctgagcagcccccacacctcagcccaaagcctcaccccttgcctgaccacaccccatttcttttggcacagcttcccagacttacaagatgtcttgaagtgactgaatggagttagtgttcggcaggactggctaggtaactactgggacttggtgcagaatgtagatgtagggctccttgttcaaaaattaggaagaatttcaagatagccacagcagagcattaaaacaaacccaggttggctaggtgtggtggcacactcctgaaatcctagcactttgggaggacgaggcaggcggatcgcttgagctcaggagtttgagaccagcctgggcaacatgacgaaaccccatcgctactaaaaaaaaaaaaaaaaaaaaattagttgggcatggtggtgtgtgcctgtagtcccagctacttgggaggctgaggtgggaggcttgcttttaagcctgggaggcagcctgggcaacagagtgagactgtgtctcaaaaaaattctcagacaagcacaggacctctgtatgactgcacaggtcacaggtcgcacactcacgaagccagcccagtgctcaatactgtattttagaataagcaggaatcagtttagggctgccagacttgcagaacaatcactgtgagggctgatggcagatccctgatctgtgattcagaaagagtcattcagacaggcattgcccagagtctgggttctctctctcctgaagttgttgaggctgtgcagaatgtatgtgtttagtgtttcatccagtctgttagggtaatcagtgtgatttctctggcatctccaggactggaagcagaccagatttaatcaaagctgttgaagctgcccagggactggctaagctgccaccctgttagtgaggccgctggggagagggaaactgaagcctgcaccacggggagccgtatactggagtctggaatccatttgctccacgcaggaggcctgcatctcaagtcaggaggcactgcctggaaatctagcatcatgttgatactctttggtgaaggaaatgtggtccttgccccaagttatctcacagtccctttgggcaatctcatgcatattaaaaataccgacaaacatagacccacgaaagatcctgatcttttaggtctgtcatgtgatagagacagtaagtgctctgtatagacatcaggagattttcttccctgaaggacaagctcttgtagcattttcctgcactgagatgcagtcatgctagcctgtctttcactcaccagggatggcaaggaaggaccagctgacaagtaataaagcaaaccagtttgtaattttacagggctctgaataaagatgcatttatctctggccaacaccaagaggcctcgatgtctctcacagggaggaacttgatgggctgtggcgtcttttgggggtgctagggcagagtcaggcttgaatctgagaaaggcaagtctgtgcattaaaatccagcacgggggtgggtctggggcaagggacaagagagaagcgggaatggaaggcagggatgaggactggtaacagaccctctgcctccttccttcctcttccctcacactggctctttcagccacttccctcactgagataggaagcggtcctgtggtgacgccaagggcacaggcttctgctgtctgggctccggcacagtcattggctctgagtcatccgggaaggaaaggcatcttttaccgccccctctcccaccgtggcctcaggctcccaccatgcaggaaatgcctggtctcccacgaatcagaagctataaacaggactggtggcagttcatacagatttggcaaaggacgagaagctgtgggttattggtatcagtgattatagaaggggaaagagttgatatctgaagataggaaaaggggcttctgaggatggtgttagcatgttcaggcacagcattaatctttaagagtcacgaagagccatcagcacagtcatctccctaataagccttgagagtgttgtcaaagacacttctggatataagtaagaaaccattgagactgagttgtatggttaaacagcacagtttttagggagaggcaaaggcaactctgtgttcagctcttagttctgacacttatgaactcagatttaaattccctgagcctcagtttccctgtctgtaaaatcaggataaaaatttcttgctcaaggccaacaaaaacaagcaatggggtaaaggactccttattcataaatggtgctgggatagctggctagccatatgcagaagaatgaaactgaacccttacctttcaccatatacaaaaattaactcaagatggattaaatcgaaatctaagacctcaaactgtaaaaatcctagaagaaaacacaggaaaaacccctcttgacactagccttggcaaaggatttttggctaagtccccaaaagcaattgcaacaaaaacaaaaaattgacaagtgggaactaattaaactaaagagcttctgcacggcaaaagaatcaacagagtaaacagcaacctaccgaatgggagaaaatatttgcaaactgtgcatccaacaaaggtctaatatccagaatctataaggaacttaaatcaagaggcaaaaaaacaataactccattaaaaaatgggcaaagggcatgaacagacacctcttaaaagaagacatacaagcagccaacaaacaagaaaaaatgcttattatcactaatcatcagagaaatgcaaatcaaagccacgacgagatactgtctcacaccagtcagaatgctattatcaaaagtcaaaaaataacagatgctggtgaggctatggagaaaagggaatgcttatacaccggtgggggaaatgtaacttagttcagtcattgtagaaagcagtttggagatttctcaacttaaaacagagctaccattcagcccataaatctcattactgggtgtatatccaaaggaaactagatcattataccaaaaagacatatacacttgtatgtttactgccacgctattcacagtatcaaagacatggaatcaacctaggtgcacatcaacagtggatttgattttgttttaatgtggtacatatacaccatggaatactttgcagccataaaaaggaatgaaatcatgtcctttatagcaacatgggtaaccatgttggaagagctggaaaccataattctaagtgaatgaatgcaggaacagaaaaccaaatgctgcatgttctcacttataagtaggagctatacatcgagcactcatgaacataaacatgggaacaataaacactgtggactactagagggaggagcgggagggggttaatgagtcagaaactacctcttgggtactgtgctcactacctggatgcaagatacccatgtaacaaacctgcacacgtaaaccctatgtctaaagtaaaagttggaaaagaaaaaatatttcctaaattgttctagaattaagcaaggtaatatttataagacatccagcagagggtctggcaccctggcatataatagatgcctaatgaacattagtttccttatttttcttacgagagtaaaatattaagatgtacatattctgttaggtcatagaaagtttgaatggtgggaaaagtcagctgttaaaatgctgtgggatctctttttgagccttttcacctgtgatcaaagttgtccatcaccctggcatttttgagagctgtaatttaaggaagaaggtatcataggttacctctgtggaaattctagaatttgaatattatgcccctgctcacttgtagactgggctgtcactataaagttaggctgacttgactgtatctgataattaggggctgggagagcatggaaaattgaagccatagataatcccagtgtcttgttttagccaataataattcttctcccaccaagtctttatcagaactgctaacaaggagaaaagtcgactggtttgagtttcctcaccttttattctcccctgggtatcttcagtagaggtgctaatgaacagtgaaatggccaaaaggtgagcagctccagggaggagaagaaggaggctcagataatccacaaactgtaatcgctttgaataattgagttaactccagtaaaatgtagagatacattcacctgctaggcattgttggaagctaaattaacacactggaagcaaagctttcttttaagtttcatttttaatctaatggtggacattttggggcactgcagcctattaaatctgctaactgatgttcagacgttatgaaggagttaaactattctaagaatattcaaggcctgttgttctctcctaggctttctacgtcaaagagtaaagtcagaaaagccaaactgatttctcctaaaatgaagagaattgaagttactctcccaaaccccagttgtaggccaggccctaaactgagagaaatggacaacccaaatattttgacctttgcccattgccaggtgaggccagatccggggaggaagtgatgttttcttatctgccttaacttagccactacgtggagaagcactgtaatgtaattaatgcagaggtgctcaaattctggtgttcctcagaatcacctcaggggcttttagaaacagttgctgggccgttctctcagagtttctgatttggtaggactggggtgggacaaagaatttgcaaatctgagaagttcccggttccagggaccgcactttaataaccacaggtgaaaccaatgagaagctgagctccgaagtcagactacctgggcttgaatctcagatctctcacttggtagttgtgtgactgggtagttgatagtttacagaatctctttgtaccctcgttttctcatttgtaaaatgggaatcctaatatctcataggattgtgagtattaaatgaattaatatgtgataagcccttagaacattccctgctctatggcaagtgtgcattgtaggttagtatgacacggttataggctctctgtaacaatgaatatagtgactgatattttttgagcacttactataggccagagattgactcagtactttgcaaggattatcacatttaatacccacaacgcactctccctcctttcccatgtcctgcttgccttctttcttccactttcagttattcctttttcccttccattctttcttgctcttcaaaagccatattgtgacaaaattaatccattctaaatgaaaaagaaaatgtaccttagttataaagtatgacctttgtgagttttttcaggactgttcacctgttctttgccttttattccagcgtggtacccggcacatagtaggagtttggtgaacattaattacttgaatctcgttatccttaaaaatcaaacagggtttatctatcagggttcccttctcttcctttgtcctatcctggcctctccttgaccaacacattggtaaatttggcctctgctctttcttttccccaactgcaggggcccacatgtcaagacaaggtggcatcaccaaccattgagaaagcttttatttcactagcttctacctggaccacccatcaaaaatctttaaaacgagtattccttgggacaaggccaggtgtcattgagagtccccaggaagagcataggagtcctggtctgggagggccggacctacactctcgggggtgcccagaggaagaacagggcctttaaagtcaccctatgttctctgacccgtgcagtggtggcatactccctcccccacccctgacctgagggtgctgtgtgtcagctctcctaactcttggtctcattagggaagctggttgtcaagtactgcccagttacagttggtttaaactctcaactaagggatcgtaagcaggtcagctgcctgagtctccagttactcttgcagctcaggtttccccttgacaggtcctgataggggctacttttgcaccattgatgtggccagggcttacagcaaggtttaaggtttccatgcgcagccttcttggcaggcagctcccagagaaaggagtatggtttgggagaaagctgcaaggcctgttcgtggatccttagtattttgagccgatcacgtggagtgggcctgtgcccatcagtaccaggagactttatacttaggggagaatctgtatgcggtgtgattttcaagggtctatttcctcattgtttctctttgcttgccctatggctgagtattaaatgaacattgaaagtctactatatgccggttactctgctagatactagcagagatggagggtaggatacaaagacaagtaaggcctagtcttcaggaagcctttatttgtgctctgtgtatcagaagagggttgagttggtgacaagaataaagagttgaggggagtgaggggctgaaaaataataagccttagagaactaggaataaagtgttaacttgggaaaattgttgaaacagttccttaagatatttgtagtagatatgtctctagataagaggcttgtctggctgtgaggtccttgcacgagacccttgcaggtttcccaaatctatttggactgggtgtcctgtattaacatgaaatcgtaggcagacactgaataaatcgcaacagagtttcggttgtggctgctccagtgtcttggagtggttgctccagacacataggtcttatcctcctgccctgaggttctccaaatttgcatttgggaagtgtatagttttatgactgtttcttttatcgtgaacttacggccaccccacttccctgcccacttccccatcagcttcaccttgggtcgcggcacatctgttctccagaacatgttccctgccaggaatctgcagggagctcttaagacttatctttctttttagctgttttttttttttttccactcaacttctaggctagtgctgagtacttatatgtcatgctgtgaatatgtgtgtgaatggattggtcagaattccaaattttagttgtaagaaaattcttttgtgcagcgtgcatggctcaaaatgagagaaaagacactgacgaggacttggcagccccgagcttttccttgggatgttatttgctttaataaattttgacctattttgtaacagaccaggttggagttccctttttaacctgctgtttcaacaaagttaagtgcattgaaggtctatctcaaaggcaatatatattttaaaaatttcagaatcctattctgaggctgaattatggctttttcttttcccataggatttacatgtacactcatctgtattacttcagatgttgctgctgtagtttggatgtttctctccccaaacctcatgttgagacctgatctccagtgttggaggtggggcctaatgcaaggtgtgtgggtcatggaagtggatccctcttgagtagattgctgccctccctgtggtggggtgagtgagttctcgctctgttagttctcacagaagcagattgctaaaaagagcctggtacctccccctgcctctctcttgcttcctctcttgccacgtgatctctgcacacgccggctcgcctcactttccgccacgagtggaagcagcctgaggtcctcaccagaagcagatgctagggccatgcttcctgtagcgcctgtagaactgtaagccaaatgaacctcttttctttatgaattccccagcctcagatattccttcctagcagtacaacatgactaagacagttaacttcccatctgactccctccagttgcttcaagggtaggcaagaattgtatattagctatttctacatccagctgtgtatccacagtgcctcttatatttggcctatagtacatactaaagaaatgtttatgtactctagaaatgtactcaagaaatgaccaaatgaatggataacttggctcatgagaattcttaagggcatttgaaatggcaaggggtatgtttggaagaaggagtgtgaggagctgaaggaaaagaggggagaccagctgtgttcagaacccacagtcatttcctcaggaaacagtaccagatatccttggatgtggggaaatgatccactcttgcagtagcctaggccacaggtaattttgtgtacccactatgcacttagctcatacagtaggtcgtaaaaatgaaaatggcatgattccttcataatctaggtggggagacactataaatacacaaataatttaaaagtacagggctgagcaccgtagctcacacctgtaatcccagcacttcgggagggcaaggcaggaggatcgcttgcccccaggagttcaagaccagcctggacaacatagtgaaacttcatccctagaaaaaacaattagccagctgtggggcatgcctagagtcccagctacttgggaggctgaggtgggaggattgcttgagcccaggagttcaaggctgcagtgagccgtgatcacaccactgcactccagcctgggtgacagagccagaccctgtcttaaaagaaaagtacagattatttcaggattaagcatatgagtacttaggctagagagaggcagagaaatgactcctgttttccagccactgtcacactgcagtgtaagccatcgacacacacatacacttcacttcatctgcacagcctttcaagataggtgtttttatctccagtttacaggtgaggaaaccgagctttgggaccaagttacttgtgcaaatcacacagctgggaaatatcattgccaggatttgaatctgagtctgcagcaattcagagaaagggcacgcacagtggcttttgtgtcagggaagagacattgtctgtattgtgggggtaggtgaactacggctggaacaccagcatgcagaggacttgccttttagctctgaggaggtcgcctgcccttgcatatctataaacaaccaccctggattgagagctgttgaatggggagtttgtctgactcccagaagagagcacagtacaggagaaaccttatataacgcagacatgcccggcatcccgcaggcgggcgcaagccaaccgcacacctcacagacccagcttttgttgtgtaggcgctgtggtgtaaaaaccatcctttagggccctctccctcgtggtggcagcgtgcctgggagctttctgttctatttgtggtatctgttccctttgatcattgtgcattgctttgttcctcatctccctctttggtgtcacctgtgaagtcactggagagccataatcatcctaaagaaagactcagagaagaagaagtaagacctaagaaaacagaccctttagcctccttggagctggttttctagttaagaggcttgattaaaagcgtggggggaatggatctgtgacgtacatggtcatgaaaagtgcagccagcgttacagcacacgtctgtataggttgcatcacaggcagggaagaggcctaagggcctggtggcccgcaggtgtgagcccctctggtggctccatgacaggagaccccgcggagaaagtagctcctcttccttttttaaatttttttttatttttattttttactttgagacggagtctctctttgttgcccaggctggagtgcagtggtgcgatctcagctcactccaccctctacctcccgggctcaagcagttctcctgcctcagcctcccgagtagctgggattacagacacgcgccaccacgcctggctaatttttaaaattttagtagagacggggtttcaccatgttggccaggcggttctcgaactcctgacctcaagtgatctgcccgcctcggtcttccaaagtgctgggattataggcatgagccaccgctccccggcctccccttcttataacacttgaggcctgtgcttcagttcatgggccttatgtaaaggcttctgtcacctgtctactccttcttcaagctggctgtttattcggcacagaggagtaaattacaggtggattatgcagtgacaagcacttttatacctcctgtaagaacagtttataccaggggtccccaacccccagaccgcagactagtactgtccgtggccttttaggaactgggccgcacagcaggaggtgagtggcgggcaagtgagcattaccacctgagctccgcctcctgtcagatcagtggcagcattagattctcgtaagagcacgaaccctgttgtgaatgacacatgtgagggatctaggttgtgtgcttcttatgagaatctaatgataaatgtcatgtgcttgaatcatcctgaaagcatccctctgcccccagtccgtggaaaaatgttcttccaccaaaccagtccctggtgccaaaaaggttgaggactgcttgtctatgccttaaaaaaaaaaggtccatttactttgcagtcatagaggacgcagggctggacttgaggaaatctacctagaaatccccttcaggttaagatttatgacattagcttcactattgaattggatcatagacatctataattaaaggaaaccatttacactttattgttcattaaatgtttaaaccacctgaaaagatttttttctaattgagcctttttgcatagttaccagttacccgtatctgacttcaagtctttagccgtatacctacatggttccatagttatcaatgtttatttacaatttaatattcttctttagcattatttaatatcaaaatgataatatgtactacggtaggttgggctttacagcttacaaaacactttgacatacattctctattatttttgatggctctgtgacatactgaactgaagcaacagtttaaggctatttctaaattgggctctgctcaagtgtgagaaagcgtgacagtcaacatgaactagctttagccttatcaccgtttcctgctcaggcaggtaagatctgctgaaggaaggaaccgttgccaactggccaggtgtgccagttcgtggcctagaaggggcagctgtcagttgaactttgcccatgttttcaggattttatctcaactcctgagtagtctcatctgggtgggagcactagaattgaaggcctgttcaaaggttttgtgcctttaactggagaattttttggaagccccttagaactgccaggcagccatgtgggatcaggtgggggggactgggctgctgtgtggtagatttgagttcatgtctcataaatggactctccccgaatctgagagggttgctccctaagtcaactacttaataattaatggaaaggagatgtgacaggaatagccaatttccctgtcctgtttggtatgactgttggcaatttgatgattccttccttaaccttgaagcaatctcagtttgactgactcatactatggggaagatagtggcctttgaactcttgactcaatacagtcttgaccttggttagatactaccttgacctctggataaaactgtactgggcattactattttattgattgttctctcaacaaaacaaccgtatctttaaaaaatttttttatcttacatgtctgaagtagaaggtcacctcttttgtagtgaaaaaataactattttccccatggtgtgctgaatgcatgggttaaagcaggtagaccagctgtcctgggttttatccctatgtgttttttgctgattcacaaaggcatttaatttctctctaccacgctttctaggtctgcaaaatagaaaggggagttcatgaccatctatgcgttactgggggatttttctgtgcaagcgaaaattattgatgcaaccagaggacttgctgccagcgtcgaggggtgcattttactccctctgtaaagaggccagcagtaatgatagaaacacagtgcatttgactctgaccttatatttgacaactcttcctctacaatccttaaaaaacatgcctcaccatttaagagaccagcagcaggccttcagcaaagcccacggtctaggcagcctttgtaggcctctgggattgtggtgagaaaaccttatccctctcttatttcctgataactttacattttagaggtgtctggaaagaaaggtggcagaaaagcagcataacctgcttgacaagtcctgtacaaacagaagtccaatgaggctgctgctctggggttgccaagctcaaggaagccaattgtagtgtgcacaaaggtgcaagtcaccaaggcctcagagagctccaaggaagcctgtgcaaaggcaggatttagagttctaaggacgggttgtccagcgcagcccagcagagaacctaggtccataactgtggactctcctgtgagggagccatgttgcggggtggacatctgacagttgtccctgctctgtgaacctgcgacttcatcctacaggtgcagagaatggttttggcaactctctccaccgcagaatgtgggcggacttctgagctgggtttgattttcctcttttgctttggagtgtacaacaatcaaccctttagagcagaagtagaggaatggaagactttcccatggcccaagacccctcagtgggttgctgtttgctcttccctagaatattataatgttcaatttatgcctccaggagaccagagacacacgtttcccaaatgtgggtacaggtggctttaagctgtttctgtgagtagaggcccagtgacatgttccccagtgtaaccccctccttggtttcacatcccctctacccgattctaggccaagcccctccagtgtagttggtgacccagaacaggtgaaagtgaggctgccttttgtagcactgctctttgtgaatgggaagtgctgctggggagaaatgattttaagtgtgagctttgctgttaggggcagccctctttctccactgcaataagaagagtcatgactaagtctagaaaggcaggttttgatctttaggatactgtgatgtatgaaataaaggtatgtccttcttattcggtgttgcattgtcagcacctaacacagtgtttaattaaagcaaaaatttttgtattgaaaatataactaggtggaggagtaagtcagtgctacttaagtgtgagtatttgtcttccctgatcagatggttttctacgtactcaaaatttcatgtagtaagaatgcaggatgcttatggagaaaagtgagtgttgtttgtttctccttaatatttatatataaaagcaagagcttattaaacttttagacgtctttggaggtttgaaatttcccactgttattcttaagaagagaagagaaagaataattttttttcttctgtcttattggcctttaaggaaaagcgaatttcagaaaaacatgggacggaacaggaagtgtttacaggtttagtcatacttgttaggtatgaaaaagccccactgccttctcatattgtttcttttatgaacttaacacttcctactttgagaataccttcctccccaagggctcaaagcccttcatagtcattaatttgcatcttgctaattttcttaaaaaattaaaatgttaactaccatttagctggtattctaccagctaaaacttccagctaaatgcattttgtctgtctgtatgtattagctcagttgaaaatgtgatcctactgaaggcagtagggtaaccggcttgtcccagtttccctgggatttcagttttagtactgaaaaccccacatccccggaaccccttcagtcccagacaaaccagcatggttgggtcacccaagaaggcgaccagttcaggtagctctgcataaagagaagatgttccaccctgcagtccttaccttaaatctaggcagctaccttaagaattgacctagacagcagtgtgtgcatggctcagtgcaaatctttagcatcacctggtagaagacaacactgagcacacagtcgcagaactagtgcagttcgaggtacgtggaaatgtctctgcaaagtaatatttctggtttcttgtttttttgtctacccttttcccctttactgcactatatggtgaaaaacgaaaacaagaactgctaactacctgatttccgaaacaagaagtgtgatctcaaatatttctgttgatctcaggtttttcatctgaaaaatgaggatgctggtctcaatttctaaggccccttcctgcccaaacttaccaggaggaaagaagctggaagtagaaagcaggagaggttcaaaaagaaaatgggatgcatctcctttagtaagctctactctggagaaggacgttgtccttcaagtacaaaccttttcaccgacttggggagtttccccccattgtatcccaccccatctttttctgccatcgtgcactgtgtcgtttgaatgtgctgctttgtcagggctgggggcttccttggtgctccagcttggccacatccgacacacagaccaccccgtcctccttctgcctctagaggaccaagaacaacccttgttctgaaagcaccctgtccctgagcctgaacacatgaccctggatgtcagaagatgctcttctccatttcaattgcccaattccagctctgtaatcattatgttaaatgatacaagtttcaaaaaatatatatttctaatagactttctattatcttccttaaatccacagtgtcactttcattcttactcctcattttggggtgaaagtgtagaaagattgtggctttagaatctgacgtactttgcttcaaattctagcaccactgtgtgacattgggaagcccgttctttaaccccactcagactctgtttctccattgatgaaatagaaacatacagtatcttatgtgtctggcacatggaaggtactcagcatattaatattaaccactttgggctgggcgcagtggctcacgcctgtaattgcagcactttgggaggccaaagcaggcggatcatgaggtcaggagattgagactatcctggttaacacagtgaaaccctgtctctactaaaaatacaaaaatttagccaggcatggtggcaggtgcctgtagtcccagctgctcgggaggctgaggcaggagaatggcgtgaatccgggaggcagagcttgcagtgagccgagatcgcaccactgcagtgcagcctgggagacagagcgagactccatctcaaaaaaaaaaaaaaaaaaaaaaaaattaaccacttcattcttcttagcccttcaagcccccgcaccgtgttttctgacatatcatcttgttttcatcctttctcttcggtttaattccagagggtacagagaaggtgtaagttacaggtaaaggagagtaagtgcactgtgagtgggtgctgatgaaatatcacaacaggttctcattctgacaactcacactaggccatgcttccccggaatatttatggaactaagtggaaaaaaggatctttagcaaggatccagcaccctcaatgcagggaatgaaatgtgtttattattagagcaatccagtttccatacagctaccaatatacacacacccacataccctgttcagccatactgaagagtttacttgtaaatccaggcgaagctgatgctgagaggtggcccgctgtactgattttgtaaaaccagcaggaaaacctctgctcggccgaccacttgatgttttagttgcagccactaacatgttaatcaaaagaagcaaatacatgtttttcccttgagaaaacatggatagtggtgtaacggaaattaccttgaattattcctcctcaagtatctatccaatctagatagatggattatctgattgcaccaggagatgcagacctggcagtggctacttctattgcagcatctttaaaggaatcagatctttggatttccattttcccatttttattcttattttctccctgctaaaaaacagtttgcagaggcacttgaaagtgatataaactccatagtagataatagttgtacatgaacatcgtatcttttatcatatagtcccctatgtaattaggtgatagcttgagcctagcacaggtggcgctgctgagccatctcggaaatgaccacatctgaactgggcgcagtggttcatgcctgtaatccccacacttcgggaggccaagatgggtggattgcttgagctcaggagttcgagaccagcctgggcaacatgacgaaacctcgtctctacaaaaaatataaaaattagctgtgtgtggtggtgctcacctgtggtcccagctacctggggggctgagatgagcaaaaaaaaaaaagaaaaaaaaaaaaagaagaagaagaaattaccatatctgtatgtctatacataggtatgtggatttatcacagtgctggtacaagtacttttgtcattgatgtttattaagctttttatgctccaggcactatgcaaaattgtagggcattatctcctctaatcctcagaatcttatgcagtagggccggtgttgctattactccattttatagatgaggaaacttaggcttggggtgtttaagtaacttctatgaagtcacacagtaagtgctagagccaagaggcaaagtaagcctggatgcttccaagccgtagctcttaaccactatgctatactgctcaaaaatatttttagaactgaatgaagacatctaaggaaaaggaaaacgtggtccctaatggtcttttgtgataacaatatgaaacctttcgtctctaaagtgtcatggaagtgaaacttgaaaggctctgttcttcatcttctacttattaatgggcaaaatgtcttcgtaatttatggcatgtgtcccaaaggtgcaaaggtggcaaggtggccttttttttttttttttttttttttttactaatactaggtcctgcttccaagcctcctatttcttcacttccctgtgtaccagggtttacctgctgcttaacccacccaccccactatacgtgtctgtagtagacccaccaacattcacatggccacttctgctgaaagtacctcccaggatagaatagggtcacagacccccaattgtataagcctttggcttcttgatgtctctgcgagttacggttatgggagttggtctttggtgagattagtggtgagatcagtgggtggcacctagggtgatttattgaatagtatggggtgaggctgaagagcaaacatccacgtaagtgttgtctgttttggagtttgaaaagttgtcaccctaataaacaaactacttaattgaacagcccttgcttggcgtgatcaaagaaaagacctagactttgctatcagtaggctctgggttccaggcctggcttgtcacttacgatgatgatgatgatgatgattttttatttttttgagatggagtttcactcttgttgcccaggctggagtgcaatggcacaatctcggctcgccacaacctccgcctcccgggttcaagcgattctcgtctcagcctcttgagtagctgggattacaggcgcccgccagtacgcctggctaatttttggtatttttagtagaaacggggtttcaccatgttgcccagactggtctcgaactcctgacctcaggtgatccacccgccttggcctcccaaagtgcggggattacaggcgtgaaccatcgcgcccggccagctcgtcgcttattatgcaagttgtataacattgctgaatcccaagtttttagtctttaaaatgagaatttaaatgtcgcccttattttgattgctgggaagtttaaatgaaacagtgtatgtgcctgtcacatagtagttgacaataaatgatagtttcttttccttttcccttaagtaagttttttttccctctagcctataagctccttaaagaagatagagattttcttttctcactcatttccatattctcagcccttagcagtgccaggcacatatttgctgaatgaaagaaaaatcttttacaaaggtcttcagatcattcattcaccagacaattgttgagtatctacagtgtatcaggcactgttcttggagcagggcagtcttaaaaaacacacacaaacatagtctgtgtccccttttttagtctaactgggagagaaacattacatagataattagagcaatgaacaactttgatccttgagatgggatttaaattttaagagataggtgacatttggtgtcaagtctgtccaggtatacttgatattgtttttgatcaggtacaagaaacggcaatatactgttatctataactggttctgaaagatctgaaagaggtgtttctaaagtatttttgaggaatggtgctgcttttttggaataagtataaatacattgtaaagtatctatttcgagagggaacagacttgatgggatgggatcatagtaggtaaggtgttccaggaacttggaacatactggaataaggcttaaacacaagtcacagaactgggtgatagggcggtgagcgcatctactggagaggagatggggcagggctggcagcttgtagcaagatttttatgtagacagttagacttcaaacttcatcagtaagtcagtagatggccctaggtggaaacacaggacaaaagatgaatttgtgttggcactagaaatactttgagctcatctaatgaggctcattcattcatttggtaaatacttcacgagtgtccagtgcaagctctgttctagttgtaagggatatggcagtgaacaaggcagacaaggtccctgtgcctgcagagttttgatgataaccttcccccctgggtgtgtgggagggcctggggctcctgtgtggtttgggggtctgagaggtggatgaaggtacagtaggcccacagtcgtggaaatcaaagtccaagctccagtgaaccatcaattaagaaacaagggattgtgaagaacaagacctagatccagactgaagggaaggatttgctgaggagttcaggccagcatgggctggggtgacttggcctggaactctacaacagtcaggacagggagtcctgaataggggcacctgcagctgagtccatggatggggagggacctgtgtaaggcactgaatttagactctgcacgcagttctaagaggtgttctcaacacgtttatgcaactaaaaagtgtttattaacagtgttttgaaacaagtgggatttttgttgaggttgtaggataattcagggtcatatggagatttttattctatcagtatttgccctgtcatgtagatgagacacgttagaggcaagcctctgaaaattagattgatttatttttctagtctgaaccgaggaaaataactacttgtcttctatctcctggtgctctaatatatgtaaaatgttgtcttatggtgagacaatgcatattaattttttaggcacttgatggaagaagtggatgagggaagcagcatcggtctttgaacctaggtcagaaagaaatggaagccatggtgtgagaataatgcatcatggtttgtatggcctttttcatgtattttaactcaactgattttctcagggcctcatcagtcagtcaacgcagttttctccatctcatagccaaggagactgagactcagatctgcccctgcccactttttttgtagttttagggggaagcataaatgtggaggaagtaaatgagtgtgtttgttcaggcttagacttttgttattttttagccttgcagggaaggggaggaaagccaataacgatggctagaattggagatagaatgaatgcaagttgcattaaactgtaaggttagtctcggtaagaggttgtttatatggtggtgtcttgggtgtatcttaccatgtagcattcttcgttttaagaaggattccttccggtgcaacatcagtcacagcatagaaagcctatgctgctctgctagtttgcttgcttgcttgcttgcttgcttgctttctccttccttccttccttccttccctccctccctccttccctccttccctccttccttcctctctctttctctttctctctctctctgttttttgtttgtttttgctttttttttttttttttttttaaatttgagacagggtcttgctcagtcagccaggctggagtgcagtggcgcagtcatggctcaccagccttgcacttcttgggctcaagtgatcctcccacctcagcctcccaagtagctggaatgtaccaccatgcccgactaatttttaattttttttaatggagacggttttgccctgttgcccagactcatctcaaactcctgggctcaagtgatcctcctgcctctgcctcccaaagtgctgagattacaagtgtgacccactgcgcctctgccctgtgccacttttccacagctgctttacctacagcctgggagtcaggccagcaaatgacgacaccccaggcacagacatgctctctaggaacttcgagtcaggtatttcactttgtaaagaacttccattttaattctattttctcctagttagagactcatctttcttctgaggggtgcaaatgattctttggagaagtttaaacctgttttacggttcaaactcaagatggtagaaacaagtcatatccaaaagagtgccccgagctctaagagttgtggctgcgcaacgttttttaggtgtctccgaagtgttatggccaagttcaggattgacccagatgaggagaggttgcactgcatagtgatgatttgtgttggggaggagagctgaaactttgcaaagtggcgtcctgaaccaacttgtttttcagcttctagggaaatttgttaggtaatttttaaaaaaagagagagagagacagagaagacttaatttgatggagcctaaactccactgtcttctttctgctgagtgctaaggggctcatggtctctgaggacagagggcaggaaaacaccttcatgccctgtgtcctctgtaaggggcctctagtatgagggactctgatgactattgctgttggggaaaagaaggaaaaggaacaggggtcaacttctgtcatcatctctccagagtttatgatgtttctgaaaggatggggaatagtgcgtggcccccactcatccctgtgaggtgctgcccaggtatccaacctgcagtgcacatgctcgccactggcactggggatggtgagtgcagcagagagatgggattcttaatttattcaattttaattaaaaaacacagttcagttgttaaaaacctatttaagtgtgtttggaatagcttggatatgtgaatttaccttttcaactgtgaattttatgaactctaaatacagatcaagtatttccagcaaaaatttagtgtcggatttgaaatgtgctctaatggaaactagacaccagatttcgaagacttagtatgaaaaaaacataaaatacctcagtaattatctgtattgactatacattgaaagaatattttggccacattgagttaggtgtcctatgttatttagatgcattttacccatctcttgtttttcatgtagctaccagaaaatgttaaattacctatggggctccccttatatttctgtgggacagtgcgagtctagacagtgccttacgggatccatcagaagcattattggactttctagggaaagttgctggacttcaaaagttagagtcataatttttcccgttgtgttaacaagttgctttatgtggatgggtttatgacaattgagggttggaaaataggttttaataagagtaagttaattgagaggacagctttacctctgttaatcagaatgattttaaaatgcattttcacccactcagaaaccactgattctcatgggaacaaaaaactacattcgtgcgtagtacgaatttgtgcctgctgggtccttgtacctttacgccaggcagaaatctccgtaatcgtcagtgtagatttcatttccttgtggcaaggaatataaagtaatacaaccaaaggggaattccactgcatgaaaggaaatattagtgctcgtctagctcttgtttcaaccctataagctccaagtgattttcagagtccctccttcaacttttttgttaaactttccagattttcctatttatagatttcagttgttggcagctacatgttggaaccgttgttgaagcccctagtaagacttgatgctgtagcacgctttcacagcttggtttgcaagttgctttctaaagatgcaaagagaattactacccactctagtagtttgaacaacccagtgaatttcagatattaaagccatattcatgccactgttctcctaattctatcactgtttagaattgcattttgtctaaaggaaggatagatagaatactactaataatatcaagatgctcagaaactgttgagaattttttttacaggaagaacttaaatttccagaggcttttaaaaaaaaatttattaaggaaggagtaaataaatacgccgggttcttgagtaaactacttttacccttcagaaccactttgtacgtagactttatcatgatggccaagagtttttaaaatactataggcagagggtatactctagagaaagaagacaacattgggtttaggactgctagccccatccagagcagttatgtggttcattcagggatcttcttagcccttcaacctcaatttctacatctgtgaggtaggttttgtgctagttctagtgacatgactcgtgggtgtattaggaggatatagcagcatgtaattgaagggcttttatcttggaaaagccttagtaggctcaaggtttctagttgtttagggttctaagattttactaactagtcagctgcttggagttcaaggcatttcttcagattataatgagttgatagtgcagtgtgcaaaaataaagaccgaaccatggtaagtagcaaggttactgtaaggaaaaaaatgtgtcccactggcccctttaaaatggcacaggtgcatctctgtagcaaccttgacagccatcatgtgggatcattcccctcacccagggaacagtggttccccaatctccaatctctccattctccagcatgagaaagtggtctggagcttgatcacatgaagatggacagacacagccttttggatgcgagagagggaagggaatgcaggccaaaagtggggtgggttttcctttcctcttccttgttttttattaaccttgtcttgctcctgccacacacaagtgcagccagtgctcaggacactgctccgtgtggagctccggaaagtgaagctgagaagccttccttggggtggacatggggggagctgcagaggcaatagggagaaaataacaaccatggctcaggcactgcttggagcagttgttcatatgtaggtcaggtagtcatcattcaggaacttcctgtattacacaaataatctctattttatggttaaaggtaggacagtgataatttactcaggagggaaggacaattagcaaattgattaataaggtttctaaaacctattgtgaaagagaatcctttaacatatgtcttgatttattctgcttatttatgtcttgatttaagacagtgattcgcaactttagctctgcatattgcaatcacctgggagctttaacagcgttcatgcctggctcccatccctggagatttacttggctattgggattgtgttttaaagtttctccaggtgattctaatacacagataatagccagaatgcctgatttaaaatgtttcctgaattgttagctgatcttgagtgcatattttctatgtactgttgcacactaatagttttaatgaaggcacagaatcttatgtaaaataaactgttaattggtcttaactacagggctacaagagtttccttcttatttcaagctgcttaatattccgttaatcactgttgtcatgcacacacacttctgtattccattctcattcatttactttttagaatggtattaatgctggtggcatttgcagggtagtagtcaccttgtcagtagaacttgctttagtaattagttgtcagaaacaaaactccccagactttctacccatgaccacaatgaagggaatgatgccttttctgagtccctattcctaagaatcaggaaatttctatgatatttgacaagtataggtagaaattacttgccaaggtgattatgacttctggaaaaaatttttttaaaggaaacacaggtgtgtaacactcctaatcagtatataagattgtttgtatgttactttttcgagttataaaaggaagaggataaattctgcctccttccccagttactgtcaatcttcagtcttcttttgaattaagttagtttcccattttacaacataaagacaagtttaattcttaaggcttacataaaaaagtaatgtttaatttgggatttctcaaattcttcatcataataacaccttgcattagtagagaacctttgttgcaagaagatcaaaatattttataagcttcatctcatttttcttttctttctttcttttttttttttttttttggagacagcatcttgctctgtcgccctggctggagtgcagtagcacaatcacagctcactgtagcctcaacctcctgggctcaagtgatccttccacctcagcctcccaagtagctggaaccacaggcacatgccaccatgcctggctaatttttcatattttttgtagagacggggtttcgccatgttgcccaggctggtctcgaactactgagctcgagggatcctcttgccctggcctcccaaagtattgggattacaggtgtgagccactgcgccagacctcttttatctttgagataataccgtgtgacgacaaaggctgggtattgttatccgaatctctcacacagcaacactgaggagacattgactcatttcttttacgttgctttttaagtacagtattgtttggttttgttgaaaattattttggtagtaaacattttccagagatataaatcttttccagactcatttgcgcttgttactgtaggtagaattcatgaggcttttcctatttctgtttatttcggagcctgaagtgacccaggaattatgtgatatatgtagagcgagggaatttcttcagtttgactgtggtcctggttgtaacccagccttcttccttacagatgggggtgagggttggggtatcccttagagcctggtgtgtcttcatacaaacagctttgctggggctgcctagagcctgggccagcagtggggtagtatcaagtacagggcattattcagcggttctccacactctcctcatttgaatgagaatataaatcttctcccctggctctcatgtcacatctttaaaacctcaagtttcttattaggcatgtgtggtccatttaagctctagacatttcgaaaagataaatcacagggcaaaacatctttctagttttgaaggaggtctgagttgcagctcgctggggttgtgagtctgagccgtcgcttttctttctcttccttttacaagacttccaggatatagccgttaaagaaggacacaaaaaagagcaaagccctcagtgatgctgtggcacaaagaagaaagctacttgaggaggaggcgaagggtttacgaagaggcaaagaatgcaggtgaagggagggaggagttaatagttaaggctcaggttccaagccctttgggctgccagtgtctgcaggagccttgctttcatcctttccttctgcccaggttttaagtctcatgagttaaaacctggggaagctcccaccccaggtccactgtgagggaacgtacaagaacagtcacgtggcaatagtacatgcctggaaggtatctctcatttggggggagattgagaagcgctgtctaatggtgcccttgatacaactaaatagcaactgtctcagttcattacttgttagccccaggcagggacaacgcagattggctaattataatagccagaccattaaagggaatagcattaatggaggagaaagcagctaataaagagctgaacttggccactttgttgtgcccaggatacaagctgctgttaatttcagtacctgtttcttctgctgttagaactaggaagaaaggatttagtgaccctctttcaaaaggtggatcacaagcttagaggcattgctggataaattcaacagcaagactttatttcttccccagaggtgacgtctgatggttctgtataaataaagtcacaccacctttcttatgctgaattgatgctgctgacctgctgttagtaggacatgcacttttatggcgtttccaggagtggtgatgtgtgttgctgagctcatctaatctctgctttgagcaaaggcaatcctctatatcatggcagggattagaggtatagcctggggctgcagaatggtgtgatttaaattttcccatgcaggttcaaagcttgtaactttgcctgcgtgtacatccacactgggttccagccacatgaactgggccaccttcatagacctccctggtaaccacagcctgacgtgacaaggaatcacagttttactttccgcttactatccatgttagaaatatctaaggaaattcaggaaaaaaaaaaaagagagaatttcatggcatgtcaagaatggaaagtatcttaattaaaatgttttaaaatgggaacaataaagaagtcgatttaagttttttgctttggtgcttgtctttaaagaaattgctcctaattctagaaactagtgctttttctaattatattcagtagaaccctaggatcctgtgaggaggcataggggagtaattgataaagaaggggactgtggtgtccgtgttttatttggagctgttctacccacactgtaatttataagctctaacttaccaggggagataagattgtatagaaccagcatcttgcagttatacggaacctttaagttctcctactccagctccttcccagtgcaagcacgtgttttagagtaactgttcagcctcagcattaagtcagctttaggagaacagtaaatcgcccatttatctggagacttcagctgtttgaaaggccttccttctagtgcatcggtatctgttgctggctctgtcctctgctactacaagcaagccttgagtctctcttagacttgtccttcctatatttgaagacatctccgagaagattttaaatcttttttcccccacaggccacatatatccttaatgccttcatccattcccctcttgggaatgtgcatctttgggccattggagaggtcttgcttggactgcggccactgtgatttctgggggcagactcagctccttcttggtgtagagatctgcccactataggcaccaaatagatgttggcaggcttctttcctccttactgcttctatttatctcacctgtacttttagatttgctgctcttgggtaagcagataagaacaagggaaatgtcttccgttgttgttaaagacaatgttaggatagaaagtaatatgtttgtactcaaaaatgcccagtgagatttctagccacggccaagttatcatttgcataagcaacctggaaatgccctcttggtcctactgattgtgtcccatggttaatgtagatccctggataaattcgaatggctactcctgctcaggggtcatgccatgagaacttttctcatacatcagatagagtccccttccgtcagctgaatgcatttacccctcagtctgtgctacccataggataagcaacatgcataagaaggtaggtgccttggcttaggcagctctgttgagtcaccctcaagaatcctgctggaattctgtgaggagtgaggatgcagagcaacgaaatattcgaaggctgctatgatttttacaagcttgaacctgtctcttggaattccccattgtgaagtcattgttgactggttggcattataaagcagttcagagaagtaaagttagatcagtctgcacgcaaataccagccacaccatctcccaagctagtgactggaactgcggttttcaagtcagtttcctcattgcggaatggagataacgatgccttccttgcagggtcattgtgaggctgaaataaaataaaggcttcatgggaacacataccacatgctcacttaatgctagctctctttcctgattgtggcagtgactgtattttccagctacaattgtgacacgtgttctgagaggtgttaagtatttatatacaactacccatatgtatttatgggtaaaaggacacggaactttaaatattgagaccatcctggaaattctaggatgtatgattgcataatttgtaatgcctgctataggcctagcctcatagttgacccttgatggatgctgaaatatttcttaatcatagggagaaaaaaaactcaatgaccttttacagagatgtttgattgcagggcttattgctaatgctctctctctctctttttttttttttttttttttttaatctcactatgcaaagataatacaggtctgggtaagaggaagacttaagatgctttgacttaattgtatctgcttgacagaagcaatatactgccttctgattttaggatgtaaccatccagaaaggcagaagaaagggacaatttcagttctaaacaggaatccgaatatctcacgtcctgaaccatctacataaactagagaaagggcactccttaagactggtgaagcgggctccttggaagatccccacagcaacattgagtttggtttgtctggcgtaccctctccccaagggctgagtgggccatctgggtaacctagagaggagacttcagatgctaggagtatagttcctacccatcctcattttcacagggtacactcatttttttccccttggaagtactgatatgtattctgcaagatgaatgttgagacccaaacaccatttggcttgtaaaaattaatggcttagcatccagagggatgttgctttcagggcaggggggacactggacaccaagaagaaagccagcttgggcccctataccatcttggatgtctaaaccatcttctggtaactctctggatgaaaagaaatcatgaacttcacttctgtgatttggtggatgtggattttgctacatcaaaatttgcatttgagtctctgtggtgttctttctagccgagatgctagggtatgctctttctttctggggagattccaaaaatgttactctctgtggctgtgtgtacaatgtctatttagaaaagaagactggcatttgcatcttctctcaaattctttacgtttgtctcactgaattttggagtggacaaaatattcaatagcttttttcaagtgaaaaaaatgtcgactttcaagagtgtattactttaggttcttgtgtatatctgtgctttcctggtggcagaaacctagaaaactctagagctcaaatttcagcgtattcaattttttgttaatgtgtctatagcttgttaataaaagcttacttaatgaaagccaacatcaccaccacttgaaatttttgcagccagaagagtgtacttaaatacttgtgtattcagacttcactttaataaatttcaataaatagcttcccataggagaggtttcttctgttgaatctgtagaagttgacgacggtacaagcatcagctttctcaggcagcttttctaaacacctgcagggtggaaaagagatccttctctcaaaatactgaatattgctggcatgaccactcttgtcactggtgcctgctgttttccatcttatctgggttgcaggtttcttcacagtgatgggacaccgaagtgcaatgggatgaaagcatgcctgtggcatttttaccctagctgtggggaaatgaccactatcctgtgtccatgacactcttcctcctcaggactttcaaactaggcttcagaagccatcactgggggcagtcctggcatttataatggggatagggacaatttccaggaaaagtttctatatcaaggacatctcagttctgcagcagagaaatctttgaaattacctgcaaaccatctttttgcaagcacaaccaactttatttctgttttaattaattccaaaaatgctttatttccagaatgttaatatttagttagcagtaggctctaagtttcccaacccctcagccttttcagagggtataataataaatgtgtaaatgtgctaggggatccccgtgatttatggaagctttatattgaataattttgaagaggaaagaccttttggtaataatattcattttttgactcttctgtaatatgcaacctgagggtgggtgtgggggaacgtggagaaatgccattctcctactgagcacagactgtatacacctattttacagggaagtcacgggctcctaagcattcagtttaaaaatgagcagaattagatgggtacccttcattggcccttcatggctaggggagaaatgggagagggaacgcagctcattttggcttcagtccttacgctttcaagagacaaccctactccatacttcattattttttttaaagctttctataatggttggtgaaatttacatttcaactcttgcctacaacagttttctgccttattttctcttcccagcgctttgtgccgcctccttgacaacctgctcataggtattacaattggcctcagaaattgcagtgcttcccttttgttcagctggttggcttgataggttgtatctgcaaatttgagagcagcgtgttttattttttacagcatctaaacaataatgtaaccacatcacggcattctgagtcacatcattgacctccaccagcagtttatccccctacaacacttgaatacattaatatcactgtctgtagcattttaatttaattagagcagcggttataatcctcttgggaaaatcgttatcccccccatacacacacacacacacacacacacacacacacacacacacacacacacacacacacacacacccctactccccataatgttaaaagaaagaaagcagctctggttttcatctgtctgacaatttgctttagaggtgggactctcaccaccaccccctcctttgttggggtcgcaccagagaagcagttgtgagagtaaagaggttccctttatttgggaaattagacgttagtgtccttaaacttctctgtctagatgtctccatctgagatagtggtatttggttaatttttccaattgctgatagtctgctgatgtgccagggtagatgttaagtgcgaggttattgcaatagagtgaaaaatgagcactgtgagagtcaacctagagattcacaaaaagagagacaaaaggagtctctgtagtgtgggattcccaagagtgtgttttgttctccttggaacagagcccactcactgtacagcatccttttggggtccccaagtgctctgcagccaccaagcccagagttaccttaggtgtgccatggctactagaagagtgctcggggccctagaagcacattgtgcatttgtccgtcttggtcaaggtaacctctcttgttgctgacaagtctcttcattgagcctttgaaaaagagcttatggtgtggaaaactgtcctccagctgagtagaaaccatcatcaggaatgtgaggagatcagtgggccacagtctcttcatctctggccttccttttataagttttcatcatgaaatagcagttgtctccatctaaaattgtttggacggggtttgcgggggatggcgtcagatcccagagcaggtgcagaagtgtggtgtttcaccgtaaggtcagggaaccatgtagaagtgaaagcacaccaaggggttacttttaaagagagcacagttgaaaggaaggtccaaagcaatgataatttagtaaattacagtatatacactttcagggtaatagctagccagactcttttgtcagctggctggggatggagttcctaagaaatgaagtccagtcagcatggagggccgggtttctcccagcttgccttggtggagttggggcaggcggggatgaggcggcctcactctcatggactagccagagtgtcttgtgagtttctctttgcttcaagggaaagaagagtcattgaatttcgaaatgctgtcttgtttttttcttgcactcatgaagcaccatttgaagaccctttggctgcccgatgttttcttcaccaagtttcacttctgcaaaaaccctaacaaaacagaaagctatttccgagaataaagttaacggtagatatctagacatatagtgggatttggggggtgtcagacaagagttgaagagtatggagaatttgttaaattctaaaaacagactgtttgaaatgctcagaagcccacctcacctttaaaaacctctgaacagattttatgtttcctatatgtgtgggctttttttttttttttttttttttttgcttttttcatcccaaaccaaacaccaaaaagtataacccatccttcaagttaaagtttctcaaaatacatgtgatgcctgctaaagttcaagaaaagtgcagttgaaagttttgcctctgggtgactttttacaggacatcttaattgacccagaaatgaaacctgggatatatgtgcctgcccttcattaagaaattcaccaagaaacctcaggatgtatgtttaaacagaaatattccaactgccctacttgcttctggtgggtgccttagggaaggtatagcaattccattcggaaattataacaatatgtatatattcatttaaaatcaaaacttcctaccacaactgccagactttctaggctatgagcagaggagaagctttaatttggttataggccgaggactccgccgcttccctttgcacatttgatgagatgtaaaatgttaaagaactatctttccaaaacgtaaacactgccttccctttacttaaatgtacgattttcttttgctcttgagttttattttcatagtggcatcttactggtctttcctttccaccatatttttggatgttgtgtgttccattttacattgcccagttaaaccacagacactcctgaagtcatgtttacatgtggactgcaagtcaacctagttggcatgttgatctaagctacaaattgcactgctgttttgccgaacccaacagtcggtttcttgccattatttgcggtattttaacttaaaactcacggtaatccttctcaccccatctagtttgttttaattgatctaacaaacactgcttgtttgaattcaaatggaggatccatggaagctctcccaccccaccctttgatacttgataaggggtcaaacagtacttcttttaaattcagataattctttgaatgaactatgaaatacttcagagggaaaggaaatatcgattctgagatggagagtaaaagaacaaggagatattcattattgttgcagataattcctagcaatgaaggaaaaaattagacgttggatatttttggttgtggtggttgtatagtgagataggtggacaatagaaaaatcttccttgtggattgaagttctaaatctagaacttatctttgaagctgtcactttacttgatcagctcactatggaagtgaatctagaatcatactttgattagaagctggggatattgctacagaagagaaaacatggctttaatatagtgatggcattaattatgtgacttgggcaagtcattttttaaaaagttgtctttaagccattctcgcggacgtattttttttgttcccttttgtccctcctttttacttgtacaaaccacagggtgtacacctattgacatgagtccaaagtaaaggctgttttcaacgatggcagagttttgttatatagccccaaggctaggcatctgaaagacaactgtatacagtgtctctacggagagagtaagccggattgcttgggaagctggtactgcccatgccccgcctcccttttgctccccaccccgagatggtctcatacctccattccaagctttcattgtctctctccccctcccctcttcctgcccttatttttaacagcaggaacgaatttcatatacacctccagagagcccagtgccgagttacgcttcctcgacgccacttcatgttccagtgcctcgagcgctcaggatggaggaagactcgatccgcctgcctgcgcacctgcgtgagtgttcgtgacccgagagggacagaggattgatggcgtggggcgggggtggcaggcagtgggctccaggccagagaggggcaagctctgaggtggttttcacaggacttcgccacgctgctttggaatctttcacacccccctacccccagatacctttgaaaaatttgaggttcctgttccttgtttctcagtgtattcatttcttccctgactatgacatgttaaaaaaaaaagaaacctggaaacatgcagtatatggcagagccaactaaatctcctagtagacaagatgatttctgtgtgtgtgcaaagtttatctgtattctcaaattcacgcttactcaactttaatattttctttggtcctaaattttgctcagtttgtgagtcagactcacttctgctttgtttttaagctgtgcgctcgtcctttctttccagggccctccctcccctccctgtctgtgctggctacttttcttcccttcgttttctaggcctgcataggtcctctctcttgcctcctctttccttcacctccactctctcttgcttctcttgtgcttgctttgcctcagcagctgcagtctgtagtggttccacctttctctcccaaatcatctctaccccttggcctaccacttccccgtctcagtcctcagctgcaacttggcagaggtttggggcccacacacctgtgctgctgatactggcctccaaagccgttgacacctgctgtgtcctttttgtctgcctttctcatactgccacccagctcaggtgataaaacaggattggggcagctggagagactgaatcacctgattcccaccctcttcacagtgtccaagaaaatgccagcttctctgccttgaatgttatcctgagggcacaagactagcttatagaggacacttgaggtcaccttggcccttccagtgacttaaatggtggcacagtcttgctcaccatctctctccagcagggtgatgctctccagttcttctcctcctgttccaccctcctcagaaggttgctttctgaatgcagagaacaggagacagaggatgcaggttcttcctttctctctctggtaattcagggaatcagatgactgtgatatgggggctcctgggggaacactgccgccggcttatgccttctgccccagagggcagacggttgctgggatgtttgtgaggagttggaggcatgagaatcctttccctcctgcagcttgctgcgtccatcagtatttacgaagttgctgcctactatggtcaagacatttctgcttcatttgggcagggaagtaaaggacacagccctactctaccatcttttcctctacttttaaggaggttcgaactgtaaaggtgccagggtcatggctgggaacatcagtgttcttaggaaactggaatgttgtggcaccatgggagcagacacaactggaaaagaaacagcagccaagtgataggaaattttcctccagaagtcatcctgtgaccgatatattcacttcagaaatattcgcctcaggatggaacatactcatgccacacaggcagaacacttctgctacctaattcattcatttattcatctcacaaatagttattgattgcctctgctgtgcccggcactcttctgtgtcctgggggtgcagaaatgaacaaagcagaaaaaactcccctgctcttgtggaacttaaattctagcacagagaaaaaaaaagtatcaaacactcatcacaaacaggctgagatttctttcataacgttttattcctatagattgcaacatcccccaaggaggccctcgctcctggttcacttctggatgccttgacatatggaagctccttaactatcttccacgagatgttatcctgacaaaacaaataagaaagcaaacaaacacactgaactggaggtcaggagatcttaacttttagctagttctgctgttcgactgtgggtaatttaactcagttctcctagcatacaatactgtgtgttgacaagaaaatgtttaacagccttcctaactttaaagtactatgattctcatctgaggcatcattctccttgctttgaattgtttcttccatactaacacttgaattttttcttgagtagacagtttccttattgagccgtgtctgtgctgcttaccagcattttggtagtgccttctgtgtgcctagcacacaaccataatagctaatatttatcacgggattaccctgtagcaggcactgtgtgaagtcctttacaggaattcttttaattcattctcacaatacctgtcaggtaggtcttctttctatctccatgtcacacataagggcttagacaatttaagtaatttttcaaggtcgatcacagaaccagtaagagatagagtcaaggctcaaactcagttctggctgactccagagcctaggatcttatatccactataccaccaaaaagtgtgtgtttagtaaatatttattggatggatggatggatggatgaattcagggttgacacttagccagtgttcactggtgtggccgtagcattggtttatggctggaatctattctaattgctgttctgtctgttctatctgttgttgaatggcttgcatatcacccttcgaaggatggatgggtccccacgtagacagctataaaatatagaactgcagcacattcccggaaacctttccatttcatcagtagttagactatggattcagattatggtaatgattttgcctgaatgcctactctatggcagtctaactttatatacctctccttggtagtctgcatgagacctattgtgacaccattggttctgacatctgtattgaatcctctggaagtggaggttcccaggctcttgctgtttgccctcagctgggactttccaaatgaggctgagcttctgtcctcccgctcccgtttcagggttctgctgcttgtcatcctgtttgagaggagcatatagcccctacgatgactgaagctgtgccacacacttaaagatgcatcccagctgagtttccaaacctaaaagaaaataaatattctaaccagggaattgggttattgctgttttaatctgggattccagacaattcccagtggaatgctcatggaaagtacggggaagaatctcaaagccaagacaacagcgggacatttatggtattgctaagtccaaggcacttgtagctgcttattttaaagagatactcatcagattggtatgcctcaaagtgggttcttttcaccattttccattgattaccagataaatcctctcccttaattcttcctttctcttctttcattcttaaatcaacttatattcttgtggatgggggtaaagaggagcagagatcatattatttaaggttctcatacagagagtttctcaccattttattctgcaaacacagagctatacccaaactgaagacacagcatgacaaattagcaagttattgagaagtagagagtgatgccttttccttttatttgccagtgataaaagcaaagtgataaatggagtaaagtgttaagtgctgattagagaggacttgaaaaggactggcaaagaagcctgggcagagtgcaagaggagagcccagggaagaaaggccagaccgtgccatcctgctctgactcactgcccagattaccaggacagtgcccttcaacagtcctacagcagaacccctctgcttaccgggagagcaaacacaagtatgtttgttgagaggatagaaagggcatcattttttcttcttcttcctcttcttccataaagggtactgaattttttttgaagcttgagggtagaagagccgaagtacaattacagtagacaggtgggaaaaaaaaagttgcattctttaaaggaacataagcttttcattgtagcttgaaaacacttgaaagaccaaggacccccaagggtgcccaggcaaggtcactcttgactctacgcagagaagggctgttgctgggagcaaaggatacctttgcccagttctcaccaggggacttgtagtctcgcaagggagggatgttttctgatttgtctacccaaaggccgccctttttctaaactcatgggggagtggctgctgaagggggcagttacagcacctcacgaggtgctgccagcctgctcattggcagaggcttaccttatgaaacactgggcctcagacagtgatgctcaggccccgccttaggataacaatataagtatagttcagattgatggggcagaatttaaataattaaatgtcgttattttaaatttcttttaaacatgatcatttcacatttagttgacattgcgccatttgcccgcagactgtgcattttgcagtgtccatttggccttctaaaatccctgtgaattatatttaaaaatcggaacgtaggactcattcatcatatttaatagggttagggtttatgatgttgcaggttaataaatagccataatagccgctcggcgttttctggagtcagaacaccagaaatagtcccttggctctctttcctttccttgtgaatctttcaaaattcttacattactactcctgcttgtgtgtgtttaataatttaatttaatgccttcctttggaaacattacctcgctgctcacccactcggctgttttgccttctcagcagagtaactgagtttaagacagccacgtgacaggcacagctatattagaaccagcatagtgagaagggatgcagtgcctctcttttctaattgggtagagcaacaattttatatgctttcacattatgtttgttcccaaaaaaaaagaggcaaaattgggagctgaacgtgatcatcattattattttatatttttatacataacaagatgcgctcatacttattgtctcacttaattgtacagcagtccttgaagcaggtgctattgattctgtttgatgagctgaccgtgtctccgataggtcaactggattgtccaggttcacacagcatgtgaaaggccgaatgtgatttctacttcttgaaaccacctttcagcttttttaggagaaaacataatgacataaagagtttcatggacttgaaagtagaggcactgctgaccgctgaagtctgggcagccacaggtgcagggactgggaccggtgtggttctagtgatgccacctgatcatgaagttgtgctgaatcctcagcagactggcttctccctcgtagtaggatgagggagaggaatcaggataacagcctgtccctgtggatggtttattctggttttgttcaccagtcctgctgcctccccgtttgttctcttgcgagctcaggttagagttgaatttctccctacaaccagaatgccagggctggtcctgtaggccctgatgggccagctctgagagtgggctcaatccagtacccaattccccagcattttgctaggggtgcccttctaggagcagggtctcactgcttttggaagtctccaaataaaaaaccatggtaatagaaagggcttgggtctggatagacgtgaatggacttgaatttcagggttggctctattagagagatgatttaacctctctaagactcaagtttctaacgacacctactaatgagggcttcttagaagtatcagagctcatttatgtatagcacctggcatagtgcctggcctgcagtggccaggtagctcaccaaagctccatttctgtttccggttatggtgaatagcctgttgaggaggtggcttccccatgcaggagccaagggaagcagacatgtcgttgtctgtgtgtttcattaaagaaaggacctagggttctgtctgtgtattattgagactaatcttcctaagtcacaatggaaataagctttgctttcaaacgatcccctgtgatttccaggggctcagttttgctctagggcactccatcccaggaccttttcctacccacatgtctctccctcagtctggaactttcttcccgttctcgcctgaatctgtgaatctccttcagccttccccactcttctaatacctatcaagtcctcccctgtcctttgctatcacatcagtgttccaaaaatggcctctcctcacagctgcctgtgacgtgcagtgatatcaccagcagagttgagacaaggacaaggagaagagatttaattctctgtcagtgtcttacaaagcagtaatgacttctaacaaagccgaccagccactagcattttctactttgttcccccttaagccttcttttgggtgccttcactttttacatccaaatgcttgaagctttctactttccccgcggcacatgtggctgtacgagggccctggttagctgcttcaaacagcttgaagagcaaaaacagcccacagcagaacagccaggatgctttggaagggaaatttcctttttgggtttgctgtctgaaagaatttccgatgcaggcagacgttaattcctagctccatgcttcctgataaggaagcagcttcaataaatgcagctatttatagatgtctttttttttttaagaaaaaaaatatataaccagaggtttactgaccttttctttcacttcacatttcatgcagtgagctctgtgtacatttaaggcagttcctccagcgtcagctctgacaaagtggccctggtttcgctgtgggggatggggaggggaggatgaagatggcacggcccctcattagtgtcacgggctctccctttcctcagagttctgaagtagacatttggaaactgttgacaatgggttgtccctacctggtgctctgtgttatttatgtgagcccagaggtgcccagctttattctagactcaacactgaaaggttatagcagactaagagaaccctttaaaaaataaaagacgatgagaaccagtccattttatgaaacttgaacagcaacaggaaatcagaaactttatttccatttcttcttttcttctgtccgttgcttcctcttggattttcccaaccctcaatacgtctgtggtctttctctcgtcttgatgggtttccgcagattgaggagttcctgtccatgagctccacagtcacccttacatgtatctacctaatgctttctggcaggtgtgataaaggttcagtgtgttggcttgaatgtgcttctctaagttacttctcacctcctctgattatcagaaagcattggttgagctgagtatatacaaatacagcagtttccatgctcaaataactgatattttctcccattttgcttcatgtgtgagttacaccacattagtaattcaaacttttggggtttctggcaggatgaccttgacaacttcatcagaggtaaacgttagcagcgacgtttagatgttgctgcttttgctgttgccatgggtggattctgattctcagttgcctgtaccatgtgtgagtgttttgtggttcatttttctgatctcttctgaaggaggggtagagcaggacttgagagatttaaactggccctggctctggccacatgctgactgtaaattcccaagtataattagtcacactgccccaatatttactgcctccatcttgggtgtgtggacaaaaccccattctttcaacattggtctccatttctgcttccagcagatcatggataccagtagctctcaaatggggctgtaagattccagtaatagaaatgcagatgatgggtacggataatggataaagaactgtagatgtggggtggatgacgattggatacctagaagggaaagttgactgcacagggctacgcagtgaataccctattttaccaggtcagctgaggctaaattctctacttctggggtgggggtactaactgaaatggttcactgaggagggtgaaggtttgtaagggaagatgtaacaatacttttttaaaagcacctaggacaagttttagggtgttgaatagcaccatttaaaaattataggggtatccagcaatttatggagctctgattgagaagtatcattgttaggattttattacccatttgttttccagaagtagctcatctttgcaaatgagctttagttttttggtcattgtaccctacctgccagctcacaggagcctgtgtttctccttaggagccactctgaggtcaaccgtgtttaagatcataaagccactctagagaatctctgtggcattgttgtgtggaagaagaaataatgatcactactattattatatatatgtgtgtgtgtgtgtgtgtgtgtgtgtgtgtatataaaagtatatgtgtgtgtgtgtatatatgtatatatgtgtgtatatgtatatgcttcatatatattatcctgaataataacaaactctgcacagtagatattatacctgaggctcaggtaaaccacttgcccgaggtcacccagagaaagtggaggagccccaatttgaatccgtatctaattccaaaacccagacttttattttccacttcaccctattactctttaaaagtctgaggagcaaatgaaagttgtttcattctatctattggttagaaggagaatatccaagctaacaggctgatttttttttccaatttttaagcataatataaattactgacaagagggcccagatggataaaatcagagctataaaccaaattatcttttgaacttgaaggaagataaatttccatatccaatcctgtatgcacactgttatctgccagatagtctcaggtatgtgtgtaaattctggagtgttagaaacaaaactaaatgaagtaaaaagaggttccttgtctattattttccatcttttttaaagagatgatctacctcacagatggttattaaacagtaagaaagatgctgtgattgaatgaagattgtgttactgagtttacaccttaaaacactgaacttcctgataatttgtgttaagccaacacgcttcagaaaaattgcctgacgtttggtgccttagtttacccacatggcatgtgtgccagaacacgctacaacagggtaagagggcagagaacatgctcttgtaggggtcagttccttgagctctggttctacgtggctgattacttgggtcatcccagcagttcattccatctctcaggactgtggtttccacatctgcaaagtgaaatggcctgagtatatgattcctaagttctccccaactcaatcgtcgcattgttctcttattccagaagagaaacacaaggggtatcagcagtggaacattatctgtaaatgccagatttcatgatcattcacttgatttttaggactcaacatcaaattttagtgcagatggtggtactttcatgacacaggaaattgtccttcgttttacctgtgattgttttgggaggaagccctcctgcaaggaaatagggaaatccaacacccagctctgttgagcatttccctatggttcctgtgattgaaatcgggttaatgcttttgtgggatgagaactggtgccagctcctaggccttgcagggcttctaaagactgtccctgccactcttgccttatgctggttcccaggaccttacagccagatcacaggcctgctcccctgttctcatagccccctttctggcctgagaattgtctgtggcttggccctttgccccatgcaacatgcacaggtgtggcttctgctaactatctacttgaccccaactgtgtgattagcggcaatcccctctgcaactcaaggcgtgtttgcctttcctgtaacctgtaaaaaatttcagtctgcgtttttctccctctggagatggtatccactgggttttaggctttacagagccagctgatctgcgtggatgggccacactatcctcccttagccggctccgtagcacatgcacaattaatactgcattaattaattatgggagaaaaaaagcacagttggcaagggaatgaaggctttcagcttctaaagtgaaggctttgatgctgagcttgaaagtacatttccatccgcctcagccagcagagagaatctgtgacacttataccatcccctgggcatgaaaactcacacccaaggaaagtatttctaaatagaggccctcaactagttgctggaatcatctactcattgccatgggctgtgaaaagggggtgtaagattagggagaaaagactcgcccaaagcagcagtgattcgtgaccaaagctgatgaggggttttattttttctccttaagtagctcttaagtcaccaacatcaggaactctttgtagagaaacaaatatgagtaagtgatttggtgccagccctcttgaggacataaaatgactctttctccttcctcctcctcctcgcatgccttgcttcaggaaggaaccctaaggtggtgcaggttcccaaacctgttattcggatgggttggaaggttcatctctgttaggcatggtttcccactagatatgaacaaagtcggggagaaaatgctttcctttttcattctgattccttcacgccattgttcttgaactcctcagctcccacactgactcctttcacttctcctatgaggtggtagtgaagccacctcacaaagtcccctctctgaacagacgcagttctcgttcccctatttacaactctgtcaagcatttttcgtgggggctcttgctgaccttaaaatttggccgtgattcaaatattcatccaggtatctggggttttattaaaggtcttttaggaacacaaaagtaggaattccctgagagaggttttcttcacttgagactcatgggttataaatgaaactactggaatgccctgaccaagtgctgagaggagcttcagagacccacaaaaacctaaaaagatgtgaaatttgtctctgatcaaatagattttggaccttatgaaagaaaataagcttttcttttgattcttagagaaaaatttttgcttcagatgaatccaagtgtgtgtgcacgcacgtgctttcgttgggatcgtcttatagctgttattccagatacctgcttcacaaagcttctgtgattattcctactactgtgacgattcctgccaccccagtgatcggggaaaagaacttgaaatacaactgggtattgtagcattggcactgtgcagacgctgtgtagctctctcatgtctggtacttctttgtttgctaaaggagtattgagattcagaaagtggctgccttctaaacctttattgttcagatagcattactttggacccaggacagagggcttatagttgactgtgaacggggtgaatgttatacttaagcagggaatgtggtcacccagttgcaatgatttagagtgctttgaacataaatatctcccacgatgaatgaccagggtgcctgaaattccattgttgagacattccttttggatcaggcattatttccacatagctccacttttaaaagtaaatcattatggcaggagatagttatggagagagataattaatacctcaagtccctaatatcttaatgaaaattagcttatcagatctcctgaattttttgaagtggaaggaccgtggccagcacggagtgggtagagttggaaataagcactataatttgcttagggctggccttctctgtggataagacagatggaaaactagatggaaaatccaggcctcctgatttagacaaaacattgtgagcctggagctctgaggccaggatgagcagtctgctacttactgtgcgtggccattgctctcaagacattgccatcatcagtcttggccaaagaaggtcaggtctcctctagtacactggcgatttgagaatgtgcaagtcatctgcatttctttgacaggagtagtgaatttgggagtataaatctgaatccttaagcctttcaaccattctcactaaatgtctttacttcagggatgatcacgtttgatcgtaatgccaagatcttgcagatgtataaagggcatggtaatccaagtcttgagttgaagtaagtggtcaggaaaatcttgacccttggggaaggagctaccagagctgggtggcctatgtgtgtgtgacagggaggaggtgtgcagaatttgggggaaagatcctttgtagttctccatgtggaataataacttccatttattgagtgcttatggtaggcgcttttcacatgtattgtatcatttaaccctctaggcagtcctgtgaactgggttttattatcctcatcttactgatgaagagtcaaacttaaagaggaaaaggaacttgaccagagtcacagaggtggtaggtgggagacaggtccatccaatatacaccttgccttccaatagaagccaaagccctattgcctaatctcttcactttaagaacatgaagaatagtgttgagttcccctttgagatctgactgtggttaaagcttcacaaatttcagaaaaacagaataactcactaaaataaaaatttaaagctaccccacagaaaacatctaccacaacccaaaacttcagggtttatatatccagattttagtgaactatatgactctccctagtcccttgctctgtctcctggtaaatactgtccctttcagagccctggcacatacatagtgtaataagatcagaccccatccccctaccattccaatgcaatctaattgcaaagtgaaaatccagggccgtcttagatcctcatctgtctacgtctctcttggtccccactgcttgatacgcagtctcaggttcaataccattctctctttttgtgctttaggtctctgtattgtttccttttcaccacttttttttttttaatgaagtgattttaaatggaaaattaaaaacttaactgtgaatctggcagtttcctgctaatgcctctttgctaagaagcttcataaaatactgtatcttattcacttcagcacagctgctgtgggctctcaccacttaaccattcacaatatgtctgagagattaatttttgtaaggctgtggtttgagatatctcccccttccttgttttacttaaaatcctcagtgggaaagcgtgcatggggaaaaaaaaaaccaccaccaccctggataaaaggtactttggtaacatacgtgctttaggaactataatttgtcattttattttcttgtgccctcttcatttgaaatgctgcagcctttctgccagaagtctcaagtttgtgtatgagactgagggggaaacgagagtaggtaccttgtgctgagactgtcctgggacagtcccgtggtgggtgtgagcgtctgtgtgatgcaggtatgcttatttcttcatgaaagccgcaggtactggttgcctctcgcagggttaaaactcttggcggctcacaggaggtgatgaagagcaagggcacgggagaatgaagaagcaggaggaaggtgtgggccagggtcggtttcggtggggtccccacttgctgggtgaaagctgaactgtttatccacacatcccagcagcagcagaaagccaaggggtgttttcaggactcagctgccaaagtttcttgaagcagctctgctcaaaggcatatgctgggctcacttctgagggaaatttcctttttggggaagttgaagcaaaggaatttcctgtgtgggcagacagagcttcctgacttgaaggcttcttggaagggaaacagtttcataatgaaatgacaaattaaagacataccagccgggttcacttcaaaacagctattgagagtgcaggcaaagccctattatactccctcacagaacaaaaataaatcccatcctgacaggtttctgtatgccggattatatccgtccccccacacctttcttcacagccttcttcatgcttcccttcctcccacccccgccattagctgccaccagctccatcttgaacagctctcgagagcagccggcagccaggccgggagcctgtttcttgctcccttgctttgtggctttgcccatccctgacctgcgtggaggccttataggttatgtgacagccctatgctgccaagacacagaaatgacctctttccttccccttttgacataaagcaatgattgaagacgtcttcagcaatggggtgggggcgggcagtcaggggagaatgcagccatttcctcaggccggcctttaaaatcttgaaggcagtaaatgtaagtgctattccggtcttgggagctgggtctgaattctttgctttgttgaaggaaatagggctctgtgctgggtggacgatattcttgtacctgaacatgtcattttcttcagttccatcagcctgcatgtggtgctttgttttgtttctgaaattgacatgatgatgccttaggaactaaatttttttctttaatggaacaggctaggagaaagaaggatggcggtatcatttggggcgtgagaacagtcattattaattaggcttaagttaatgaaataaaaaaggcacaggctttgaaatcagttgtctaaatttaagggccagctctaacaatatacaaccagcaatgtaaccttgaacaagtcactgaacctcccagcctcagtttccttatctctaaaatgggtacagtcatacctttttcacattgttgtgaggaaattagattatgatttcagaggcactttgtgaattcctataagccttcatacttcttattaaaccactattgggatctctggagactgaaatatagtattaggctaagacagcagaattgtagaatttgtagatcaatttggcaaatatttagtagaagtcttctatgtgtgcagcatggctcgactctgtgggggaaaataaacaagtggaaagtttcaggtggccgcatggtatagcagaaagaatattggacttggggccaggaggccagggttcaatcctggctgtcactcagttgcctgtgacttggtatgaactgtttaaccttgatgagcctcagttgctcatctgtaaaactgggagaaatcaaactctatgaccttaataaactctgtccaactctaacattgtataatcagttttaagaggtttttgcctttagcagctgtttataggatttattctaaagagtagggaagaaatattcattgtataagagcttgtctgatgaagaagattgcatgaaaaagctacacttttttaataagtatatctgatgtaaacaggaaaaatgggtgcttgccagatatgtcatctatagcaacttgttttgagggggtctctgaatgctgacatgaaaatgactaggatcatgggttgaacgtgagtttgctcaagagaaggttctcttggggctttggtttacttcctcccagctgctccagggaacactcaggatatttccaaatggctgctcatttaagccattcccgttatggttctccttgtccaaattggcttccatggtacagtcccagtgttgactggttctgctaatttgattctttttttttttaatgtgctgatatgtagttttaggactgctgcattattgttcctctatctttccgtttgtattagtaaagaactattagcaattttgcctcagtcttctaagcacgctttttgattggagaaaaccaaggtaccagaaaacttagataccatgtggaaagtcacagtttactgggtgtgtactatgtgttactagtgctttaataaatttcctcattaattttattctcccagcaagcctggcaggtagctgatagtatctttgctttacacatacagaaactagggcttagagatggtaagtaattgggtcaaggccacagaactggctggtagcagagccagaatttgaactcatgtctgcctgctccaaagcctgtgttctttatcccctcagtgcacccctactgttttgactgctgttaaattgaccttatgcttagaaccgaagtcaaacccgtaccagggctgcaaaaagaaacaaaattaacctcatagtctgcatactctcgaaatggcaaaaaagcctgcaactttccgttgtggaaaataatatacctgggtgataaactgagcaaacatcacccttgcccttgcctctgaaagagagcctgttctagttcatcctggggccagcttggcctggaaccccactggccagctctgtccacaccttgcatattaggacagaaatctgcctaccacattccagctacataaagaaggtggccagcacctgactgcctctttctccttgtgaaattccttggaaataccatttgtgactgcttgggcttgttctgaagaaaattcaaatcttgttctgtttaacaaggattgattgaagaacccgtaggctcagtgctagtacaaagataagcaaggaaggaactcagaataagagagaaaaaacttggataataattatcaaaaccagtatttattgagcacctactgtgcccagtagagtagtaattacaggaggtaaatatctaaaacttacatagctcttcacagaacatacatctgttcttgcttctgtgtttgattttattagctttcctctgtacacataagcttttagtgtatgtcctattattgaagtccagagttttattatttttcacttatttgggcatagatagttccagaatttacttgtcttcctcattctcattgttaatctcatttttcttccctggagaatatggactttcaaaactatttttcaatcaaggccaaaatatttcttaaaattcacttctatttaaaacacagataacatccaggagaaaatctgagaagaaaaaaaaaaacgattttgatggtacctgattataaaagactcacagtactaagttattctttggcacgtgtagcaaaatactatgtaggtgtcatttcgagttcatagtaaggggagaaatggtgtcatttttcctgcagagaaatttaatctttcactttaatctttcattggcctatagcagccagtggggtcttttaaaaaattcttttccttcatattccccgtttgagcttaaggtacaaaaaaagaaaatactcttgaaatgctgtgaccagatctagactgtaacatgccccttcactcctctggtgaggaagtgcgggaaggtggaagacattgaggggttgattatttacttcgtttggaagtaagaagggaggtagctcttatttggaataagagctgtcttcagaacaggtgtgtgctctcctgaagcccagagctgtgactccctgggtgtgtctcttacctgtgcccttgggcaggtggcacgggagaagaatacgataagaggaggatggtacagacagaggagtcacaggctgaacaggctgtcaccggggcaagatgactgacaggtggatggaattcaccatcctttcctttcaatcaaaaaaaaggtagaaagttgctcataagtaagtttgagttatatcatcttcttcatagccgttgctcttcagacacaggtgctggtaatcaggaaaatgcaaggaaacagctctggggaaaaggaacaagcctcgttggccttgagagccccagtagaccatcaggccttgctttggatattgggaggtgacagtgccttctcacgtgcctgacagtttccctgcaccaccaagactctgtgtgactgaggccgtggcccgggtttcaggatgggcattcagaggaaggaagttccccctccttcacttacctcacgcttactagatgctgggttgcctatgcccatgttaaaggaagccagataactttctgtccccatgtgatccaggcccatcctgaagcctgggggttctgaacataagtatggcggttgcagccttccttctgtgacttctggaattcctgacagagagggtcatatctagccactgtcaaccggatgctagacttgttttgttaggcccttcctccttcccttcctctacttatcttccaataaccttaggatttggaggaaattaaaataaaccttcttctagaaaggtgtcagggacccatgcacaaatgtagcctttttgatgcttgagaaagaatgcctttttgacttccgtgaataaagaataagtcacggctaatgagtaagtaacagcacgtgcctgtggtcccagttattcaggagactgaggcaggaggattgcttgatcccatgagttcaaggctgcagtgagccatgattgtgccactgcactccagcctgaacaacagagcaagaccccatctcttaaaaaaaaaaaggaaaaatgcctatgcaatggctctgaggcaccctcatggttgatccaatggccttgcctagtgattttgacatgctttaacttgtgaccaacatctagtctatttgtctcccattagagactggttgtgacagcattgccattgacctgccatatataggaactccagtgtctgaaaacatagcaggactttgtaggtattaacattgagcagtgctttcacattttacagcttaccgtgatgagcaagatattgtgtcaaaaatagtgcattgcagatatcaataagaggtagggtaggcagtgatttcagtggtgtcccactccacactgtaattttgtttctttggtcaactaatgtaagaactgagtctgtaactctaacctagggagccattgctgtgtgtcaactttgttgctttaaaatcttgagacaccttttcagtatctcccactttgtctgagtagtcatacttttaatgatatttaaaagtcaaactctaaatactttggagctaaatctcagcagagataaacttcaaactggtgggagtgggggtagagaaacccttctgggagtcagaatgagatacttgtgtgtctggactggtggcaggtttgtatgttaccagagtgatctccatggtaacggatcaacatggcgccaatgacaactctacactaagagcttcaggttcccatgagaaagtggatcctcacagcaaataggaagaaatcaagaaatatggatccacactccccttccctgtagaattctggccgtgaagtttcagttcatataaccaacaccatgtcctatttaaccacttgggtccctctgagtaaaccaagactcttctgagaatgcagtgttctctcagatttcaactaaattcatacaaagtttaatcagacttgcatagcaaagaactatattgcagtggagcaagaatgtaacttggagtcaggaagcctggcctccagacccagctctgacactgtgatatgaggaaatcacctcgcaggttcttattttccagattctcaaattcccaccagtgctgatggtcaatcatccaattatattgaaagcccttagtatgatacatcagcagtaggaaaggtagatgactaaatataatacagtgtgccttttcctacaccatcaaaggtatgataatgttgtgatcatgtgtataaaaactttcagacacctaaaaagtagaaggtgtgattcatctctgttaaagcttaatctctgagcataacaaccaacatctggaagctaggcagccaacagaggggttaatttttctggaaccttggttgcaaaaggttattagtttgcagaaagactcagagatcactgtttatcttaaaccacaagagaatgtttttgaattcagaagaacagtgatatagttcggtaatttcatgaacctcttccctgggaaaccttatgactcaacagtcaaaggtgtccgaatagtaaagatggttttcagtgatcaggtctgtgcccatgcctggccttggatagactctgaaatgagattctttgtttgattgatggggtgatggtttctgttgtgtacatttgaaggaaaccagtttccccacccaaaatttctaaggagtttaatctttggggtataggggagttaaactacactgagtcaaggaagtaattgattgcatatttcctctaaaagtcagctatggacttgatattgactaaaacaaactagcagttctcttccaccaccaagtcagagcgtctgttcaccattctgcatgattaaaagaacaactaagaatggtaatgctccatttaaactttccttgtgattctctctggtctaccttcaatcaacaaaagcctaaaatttttattttagaatcatgatgttggaagatctttagattgctcataccataaagctgtttctaagattggtctcgggaaggtccaagatcaggattgaagtatgaaaaatcttggccaggtgcagtggctcatgcctgtaatcccagcactttgggaggccgaggcaggtgggtcacaaggtcaggagatccagaccatcctggctaacatggtgaaagcccgtctctactaaaaatacaaaaaattagctgggtgtggtggcggacacctgtagtcccagctactcgggaggctgaggcaggagaatggcgtgaacccgggaggcagagcttgccgtgagccgagattgcaccactacattccagcttagtgacagagtgagactccatctcaaaaaaaaaaaaaaaaaaaatgaaatcttgatcttattgccttgtcacctttttgtcttaagtttactttgttggtataaagaattttttttaattcagcaagagctcaaagagccatatatatatatataaatttttttttaattaaaaatctttctgctcaagtctcaactacagtgagactgaatggaaaatgcaaaagctcttgacatgatgtcggaatgaacaagatggagaggttgaatttgagaacatggtttccttattgtgaaattccagtttcagaacattggcactgtctggttcaaatataaatacacattattttattgtaatccgctagtttaaattgtttattctgcttataaggaagagatccatgatagctgtgaacccctttgaaggagactttatccatggctcagtccaaggtgtttgaagcacttttctcatggcctggctggaaagactttcagaaataagcagggttctggtaggaaaatgaaggcagttgaggaaaacagtgcacatatttgtaagaggactatacttggtatcttggaaaacataaacagaccctagactgtctaccccaagtctgggaaggcggtcctctgaagctgaggttctcctggaactcccttccacagggctgcgttgcaaatgccattgtggaggcatcacccgatgtggtggacctgaacattggggaaatgcagtgctgcctgctgctgcgctggctggcatctgccctcctccgtctcctgggtgctgccacagagaagagagagagagtgaagcgggcagagactggctgttgccatcacacaactgagggcggacctggagctcagccggctgagggtttgagagaccgttgggagcaagacccaaccacaaggcccatggaagaggaagttggcagatctcagaaaggggaggaaaaggagaggtgcttatttgttcatcttgtttttgcttttaaggaaaggaggagagttaaatgagaaaggagggcgagttgagaaggttctgagcagtttcaggtccacggttgagcaatgttcttcctggtcaacaaactgcctggatttcattttggcctgacaacagccccaccacctagggaactgcacagagatcctgtgtgttaaccacgcaagagagtctgcagttagaatactggggcttgtgcagagagaagaattcagaaagtcaaaggctggatgtaggtgaagagactatggactctgccttcatgtcatcagttaaagtgccctgcacacctgcctgtcctaggtcctgtagggatgtgatataacaagcatgagctataccttagtgtctgtgttccagaactttgttggctcccgaagcacctttccctcctcccaagaggaataaacaaatgtaaataaatggtgcccaggttttcatttggctcacaaaagattatataaaactcatagtctgtctgaagtatgttacctgtaaacctgtttcagctaaccaccttttctagcacaatcaagctggtaaaatacatgcctgcacgccagccacggtactgaggaccacatcaaaactgctccttgaaggaacttggagaaaatgaacaaccagcaacttgttagctggtctctgaatgacagagggtactgctttagatgtcccccaggaattctgagtttatgcagcagagggaccgtagccccggggtcaggcaggacaaggggatcagaccttcctcttgctatgtgtggatcattattcagctgaatgtctctaatcaggaactctgggcataaaaacacgatctctgcagacttgtgtgtggctagacgccctctgtgtgctgtatttgtaattctctgtctctgtatggtttcagccttggaagaagctttgaaccagtgatgagtttgctttccgcagtcaaaactgtggtttgagaatttcactgttaataattgggagtaaaggaaaaagctgggctattgaagggtaaagccgatgtccctaggactgtggcctcaggaagatgactggatggcggcagcagaactgatggcagaaaccagggaagctgatgttgtattgcagcctccctcacacagattctaatcctagaaagtggactgtggaaaaaaacttaactattcacaacaaacgtttaccagtcttatttagtggcaggccttgtgatgagtgctggggttaaaccataagtcaaatacagacactgctgtctttattattcattaaaatgtctttagggtaattttgtatttacatcttcagcaaatattaactgagcacctgtgatcaaccacatagctgctaggcactgtgaataccgtggtagacaagaacagacgcttttcttgttaatccgtggaatttacaatctagaggggagactccacctaccccaccagatgtgtgcagaaggcgccatcactgctttagtttcaggtctttgctcaggtcattgctcacactgagtccacatttataagttttcctgtcgggtgagctgccgaagggccagggaacgtgataaaccatacaagcagcgcatccaagaagtggtttctgagcagtcactgagacagcgagggttccctgcactgagcaccaagttattactattttccatacacgtcaatatgttattgattgcttcactgtgctgatctgtttttgtttcatgtggctctttgggtctgtctaacctggtattttcagtctcaccagcatttctaaagttctagagacccatttcatccaccttacaccatgtctaccacagtgccaggcatcaagcctgctaattgtgcttgatggtgattattaccagccccggatttgtaagagtcaccagcagtggcatttcaagatttagcctgggagctcacggttatgtggaaagaggggctcaagactaagcccagggaggttttggggtgatagaattgattctttacactgaacgtgaatcctcagtgatgttttgatgaggatgcgggacattgtgctatgctaaagcccgtcacagcagcattaaaaatgtcccagtatggagacctgacttacaccttggctcaatcattaaattaaataactcaccaaagaataaataccaacaaatactagaaatgttgatttttagaataataaaatatcagtttttgttttttgaactggcagggaatttttttttttttctttttgtagagacagtatcatgctatgtttcccaggctggtctccaagtcctggcctcaagctatcctcctgctgtggccgcccaaagtgctgggataaaaggcatgagccaccacacccagccagaattttttaaatgttaattttcaatacacatgtagctatgaggagatggacacattctttctatctgacacacctggtcactccaaacgttcagcacttcacatgggaggctacatatggaagtgaaatgaaaaatcaccagcagccgcagaacaaaaatataatccagtgagcataacttttatggaagcacttcagcaatatgggtaaaggacctgaaaacacttttgctctttggctcactaattccttttctaataacccatccctagggaacactctccgatgctgacaaaccttcttacacatggttctgcagagcagcagaggccaccaccagcaaggttcaataaattaaggcaggtcattatgtgggactattatgcactaattaaaaatcacattttttaggccgggcgcagtggctcacgcctgtaatcccagcactttgggaggccaaggcgggtggatcacaaggtcaggagactgcgaccatcctggctaacacagtgaaaccccgtctctgctaaaaatatttaaaaaattagccaggcgtggtggcaggtgcctgtagtcccagctactcgggaggctgaggcaggagaatggcgtgaacctgggaggcggagcttgcagtgagccgagatagcgccactgcactccagcctgggtgacagagtgagactccgtgtcaaaaaaaaaaaaaaaaaaaaaaatcacgttttttaaatgctcatataatataattgaaaaggcagggtacaaatctctctcttcagagtcatctcaattgtttttaatccataaaaataaaccaaaaggctatggaggaaaatagttattgtggttatctctaggtagaaggattgtgggtagaatttctttctctttactgtggagtttttttgttttttttttcttctggcattgcccaggattatttctgtccatcagggcgtagtgggtcacttctgtacccagcagcttgcacctagatttattgtgtcaaaatgcaaatctgggcgtgcattttccattgtcccctccccacctgcgcttaaaacccctccttgtcttcctgctgtaagtaggataaatgcaccagctgtactgggcctttcccatttcccatgctgatcacattctctcgcctctttcttctggctacaacacacttcttcattccaaacccttccccctgacccacctccaccccccaccctagcaagattaattccctgtaattctagttcatccttttggccccagtttaagccatttattcatgccaggctttacagaagactcaccagcacctccaatgggcttccaaggtgctctcaacttcccttaacacaggttcccagtttatcctcaccactgaagcccaagagctgggactgtgccagattgatcaccagtgcattcccccagcacacagcaggactcggctcaccctggatggttcttaagcatttatgaatgggtggatctcacctacgtgacctggaacttctctgttctcagagcaagccatgtcaaatagcagaaaatgcaccggctttggagcctactgcaggactagatgtctcagggtcgcagtttcctcatccctaaaaaggggaatcacgatgcttatctcatgcagttattgtgaggttacaagagttactgcttatgaagggccctgtccagcatctggcacgtggcaggtcctccgtgaatgacagcgccttcctgggcagcctggcgagcgcacacgcgtgtgcacacacacacactcctgtgtttaatatagccctgtctgttgtgagccacttgaggagaggtgtccctagaagaaacttttttcccagaaaatgaggcctggctggtgctcatcctgagttcctggaaggcagtgttttcttgtaaccatctgagattcctggggctgggtatagtgcctgatgctctcaatatatgcgtgttgaatcaaaccagaagaagcaggctgaggcactgagtgaaaacctatgtggatgtcctgctgccttttccttgtggagggtagatcattcccaactctgcctgaaactttgatgccttattggaggaagagaaaggtaactcccttgttgagccatagagctcttagtttttctttcttaaaaaaaaaatcactcttctttcaaacaccattaaattagtccagttatgtacactgggcttgtattgcatggtttatataaaagctaagttctttctttaagattggagccctccgtgtgagtgatttcaggataaaaggccttagaggattagacacattattcgtttgtaaaactgattgctcaagtgatacagccctagggctgcccccttattgtagcttcttgaacactgtcaaactgtcagacttgggttggtggttattttatctcgcaaacaaccaaaaccagatttacattgtaagtagatactagcgtggcttttgtccttcctatatctaggccctgaatacttcagagccagattaaatgctttgctctattttttcatagatttgggcttcgaccaaacatacaagttgagcctgttgacttctctctttgtggatgcacacgtgcgtctctgcgtatatttgtgcatgctttcccgaataagtcctcttttaaaactcagcctttcatcattttagaaatgatttgctcttttacagcttgtactttttatggttcttagaggatcactgcagcaaatatatttggcagaaattgagcacacaagcccttccccagaactcagtactgaatttgttcagttcccatcttaaaaacttgaaactcctttgacttttcctgtgatgtgcttatttctgatctgaaactgtagttcaaagctagacttggtaatcattcacgtcaagaaaggaatggattgctcaaaaaagaagtcagactctaaaaatagcctccataccgaggcccacttttctacctagggaatcaagacagaaatatttccaggattgaaatgacatagttcaagtgacgcaaccatttggctgcctgctatttttctcttttctgccagaaggaaaatatataatgtagaaaaattcccctagagttgttaaaataatcactgaaataacctttggtgcttagtatggtaccctggaaaacttggatctctagaatggttcatttcagagcttttccagatagccaagtttttattagaaaattggttggtatagacggtgctcactgtgactgttcagtgcatgatgagaatccttctttacagagataaaaagtgtgaagagaattgctgagaagtaaccattcattcccttctgcatttgcctagtgtgctgtgtaattaaatgagctgataaaatttacaagaaataaagctttatgcaattacaaatagatgacatgactttttaaaaggttttgcccatatttttcacacacgctctacctttagccttctctgctttcacacagatgctgaaaaacaaaagagttaattagaaaccattccttttctctctttctggtacagagaaggcttccactaagtatgtgctgaataaatgacccagtctgaaagttttaatttattacacagtatattcatagaactgtaactgttacaacctctagtttgatagatgtagctgtttttgtttttttaagttgagattatattaatatctgtcacttgggttgccagccttttagaagaaaatttggggtttatattagaataggttttaggttcagtagcctgtatccttttttactgccctgggacaacagcaaatattcacctaaattcattctgtggtgtaacactttagaagtataccagttcttccttgcaaataacaacaaaaagctctgaacaacttaatcacagagaaaaaaaaagcttttattggaggtatattgggcagctcattggctgataaggtagcagaagcaaaaggatacttggcagcccggagcttagctgagatggagccataaggacagttttattaggatgccaccacagctcggctgccagtggacacatgaattcgtgagactagcacctctgccataaataacatctcaccatccctggggaattggtcactcccttaagactcaaacactgtggcaagtgcatctaattggctgagtccaggttatgttccagggaacaggggagaaagctctgccaatcttgggattcccccacatgcggtatgtggatgctgagcagacaaaaatatagaagtctagtagatgattgtaagttactgtatagcagtgtgtttcatcttgttcttacgtcctgtggaagctttcttcatggcgaagttaagcagttccacatctgcattcccccagatcagcacaccaaaggtgaacagcttgggtttccccctactttcagttacaggtacaagatgttagcaaactatgcaaatctcaatgagttttgtttcctaattctgtttgcatgctaggaaacttgcctcatgatacaacagtaaacccctgctttaagaaaaacatgaggctggtttaatatgtacaatgtccaactcttaggaagtgtttatttttcaattgcctttaataatttctcataaagatcgatgagtctaagaattgtgaaggacctcagagatgatatatttcaacttgtcatccacgtcacgactgtctctttagcatcccagagatagcaggacagtcctcccctgcttgtgtgtattcagtgggaagtacttccctgcccccttttcgtcccgttcttggatggtgctagatgtgaaaaatagagttgaaactcacctcactgtcactttgctcttggttctagttttgccatgtgaaaccagatagggtgtattctttctacattaagtctagagacagaactttggaatcagatatggatttgatgctcagctttgccatttacccaaaatgaaacagttactttaacagtatttttcgtctaatatgtgcaaactaattgctgaatggataggcagttattttattaatgcaacaaaaggttatgttagcattttaatatttgtgttgtattcacattgatcgtttttacttggactatagccaaagtcagaactcttcttttgtggattttttaaacttaaaatatatgcctttacatttaaccctattacgttttatttaagttggctgaggtaatgcctatcatcccttctataaactcctctttcctactttatggcttctatattagatgagtactttctctgtacctttatgttaattatttggaagggaaaaagattgaatgggacgggacctgtgaaagatccctgtggcataccgctagagactgccttccaggtaggcatagttttaaaactataaagttaactttatagttaacaagtatattgtgattatgttttctggcaaataaatctctttgctgccatatgccataaatgacacattatcatttttgcaaatatgcacaatggtactacatatcaattgactgtcagcctaacccataagaaaaagtcaggatagactgtcaagttatttgctgaaatcagatgcactgcttggctctctgtaaaatctttaccaagtaccctctttcactttactcgtctactcatggcaaatctaaaaccttctacttcagcttaggcaagacatcttcttgggtcagtggtagatgtgaacaatcttcgtgggtcagtggtagtttaacagtttgttaaactgttgttaatcaatgtatctactctcggtgattttaagagagaaaagaagactttttgtttttgtctgagaggagtttttaacctggaaagacagctgaaacgttatctgaaatgtgaaatgttaaacattttattattaagagacagtgtgttttttattttactcacacagtatgtgtgcatttgtgttttctgcgactgcacatttgtaataataggctcatattttgtttttcattttaaaattggctttgtaggatgttcactaatgtggaaagacagagggattggggaatcactgggaaatgcttggagtcagtctgttatgtagatgtgcaaggtattgactacagagtgagacactcttgcttggttatgtcctatttctctctgaattttttaattctcaaaaagtaatttagaactataacaccttggtttgtatgagtgtaaaatgatttataagataacctcaggtgtgttgacagaagaaatgcaattaaattgtttccatgtttaagaaaaatatgggaggtatatgtattataagtatacatctattgactggctaaagaagaaaagatgactagggtatgccatgctaaggagtttagattttgtgctggaagtttaaataggggagagaagggatgtgtgttcagaaggcttttgtaggtagcagctgtagcaatgatctaggtgagaaaaaaataagtacaagccaaagcagtgtcagagagatggagtgaaagagaaacattcaagtgattaagcagattgattgggcaaggtgagtggcagatcagatgaggagcaagggatgggaagcagaaaagacaagtctccgtggagcccattatctagagtggcaagacgagaaggaagagcctataagagggctccccagagagacaggagggaaatcacagagatcaaggaaggagaatttcaggaaggaaagaatgatcctgcccaatcagatgctgcatagaattcaggtaagatgaggactgaaggtgtctttggcttttccaagtagggaagtcatcagtgacccagtaagcacaatttctgtggcggggagaggcaggtggaaacctgattgctgtgggttgaaatgtggaagaaagtgattatagatgactctcttactggattggaatcgagagaaaagataggatctggaaggcaacagcgggtgaagggaggtttttgcttttgttttgtttatttaatggacggtatttagccatgtagaattgttggtaagaatcagagagttgaaaataaaggagaaatatggggtgatttatggaacagagtccttgtagaagtgagaaaaaataagaggcaaagtaaaaatggaggtattatttcattttcaatggaaagatggacacttgttacactgaaatcagaggaaaggtgtgtgtgaacataagacagttgtttgtatgggggcaggcttcataacttgtggaaactcccacttcacagcctttttgtttgtggttggttgtttttttgtttgtttgtttgtttgttttgcctgagaagccaaagatacaggaggtggcagtgaaggaaatgggagagtgcctgattgagccaagctggggtccccccaccgcgtggcatcgcctcccagtgggaggcctggagtttgtattgatactaatttgtctgtctgtgtggtttccccctgtgctgctcaacaccgtagtgtaggaggggtgaaaggagatggtgagacccattctttcaggaaatattaactgagcacctgctatgtgccaagtgtgttctaaactatcaagatacaggccaggcacagtggctcatgcctgtaatcccagcactttgggaggccaaggtgggcggatcacttgagatcaggagttcgagaccagcctggccaacatgttgaaaccccgtcttcactaaaaatacaaaattagctgggcgtggtggcacccgcctgtaatccactactcaggaggctaaggcaggagaatcacttgaacctgggaggctgaggtgggaagattgcttgaaccctggaggcggaggttgcagtgagccgagatcacgccactgcactcgcgcctgggtgacacagcgagactccatctcaaaaaaaaaaaaaaaaagatacagaatttaacacaggaggagcaagccatgtgactatgtgagttcaaagtattccaagcacaaacaacaataaagaccttgaggagggaaagtgtttgatgtattaaaaggaacgcgaggaagcaaatgtgtctaaagtgattggcaagtgaggaagagcggagttcggaaacaggagtggggcaagaggacttgggaggaggctgtaggccactgtaaagatactgtgttttttgtcattttctgagacaggctcttgcctcggctggagtgcagtggtgtaatcatagctcactgcagccgcaaactcttgggctcatgatccttccgccgcagcctccagagtagctggaactacaagtgtgcaccccgtgccttgctaattttttttttttttttttttttttggtagaaatgaggtctcactatgttacccaggctggtctcaaactcccagcctcaagcaatcctcctaccgcagcctcccaaaatgctaggattacaggcatgaaccactgcgcctggccgggactttggcttgtattaataatttgccaatgagaattgtaagcaatggattgacatgctctttgaattttaaggaatcattctagctattgtgtagaggataggaagagggagagtgggagaaaggagggggaagtgtgaaagtagagaggcctgttagggatctcttaataagtctggcaagacatgatggcaggccgtaccaagcatgttcctacctcaggcctttgcacttgctgacctcgctcgctgggatgctcttctaccaaatatatacttgaaccactgcgtccctccttcagagatatctgctgaaatgtgaggtcttcatagtaaacctcaccccttcacttgtataccctttccatgacattttttcctctataacatttatcaccatttgacacagtgtatattttacttgtttatttacttagtgcctgatttcctgactaggatgtaagctcaagaacagggatttttctgtttcgttcattgctgtgtccctgatgcctagaacaatgcctgcagtgaggaggtactcaataagtatttgttgaatcaattagggaatgaagctcttccatctccattatcaccaataccacctctacagttataattagtgagaattatggcagtgctaatgttattttttcatttccatgtgtgcctttttggaaagacttgctgcaacaagcttcacatatcttcctctgcagagtagaagtatgtcactaagccatggagttgatttcttggctccttgtatagcaaatagccttgcatttggttcgtgtcagtctttgcatctttttttagtcacgttgcctacacccttcacaatcctctagcttaaactcttgagtaactctggacactggcgttagctggaaacttgagaaccagaggaatgatactgccaataacatgccttatgtgcttggcatctaattttggcacttgttttagcaggtttgattgcataatttagccattggctacaaaaaaaaatggccacatatcctgggaggaagggaagatttggaggtataagatggaatctgtcctagggatttgaggacgggctacggttcttgttttttttaaaatattccttcattttcaatactcttgggattattccaggccttatgcattgaccatcactcaatattacttcctttggggagtatggtatgacgccatcatttctggtcttttcatatgaagtctccatttttattatatttttcatgcctgaatctcaggttttgcaatattttctctaccacaaaatctgttatcaattaagtacaacttaatttgttttttttttcacttttccctaattaaagatatatatacgctaattcagaataagtatgaaatataataactggaaataggacatataattgacataatcccaaaataaaaacaaataatttgtagatttagtcctcatagtctcactggatcaatataggatttctgatcaaatatgatgcattttgagaaccctcagtttatgtctagaggagagtcttttatttttaatgtgcgggatttaagttgtaagtgaagaggactgcgtcaagaggcaggatagtagttctaccccaaaacagatgtgtgatgttgaacgagtcacttggagaaggatgccatggagagtattgggccaggtgatttctaaagactcttccagcattaaaatacattaattctttgcatacatccatgccttttgctgcttttgcagctttcagggttaatgagagctgtcaggagcagtatgaccttagagggaaatggctcatatcaagagagcagatgccaatcccttctagtactctccctgggcagatgacccactccctatttaaatccttggctttttttcttctctgataagtgcctgcataattgatactgttgccagtgatcaaacgctgaaatgactaaatgatagagctgaaaaagaccctaaggtgttatctagtccaattatgccccctaaaccccaaagagtctgaaagagtaatggggcccatgagccaagtttagtatttcaaatgtctcgtggtaattctatatttggagacaatattgtaaggttaagcaagctgtggaagcatgaggttgctctgcttatggctggagttataaatgtgaaaatggatcagttattcctagtaactgctcttgagtaagcagaatctttcaaaatgtcatagctttgttgtctaatacataatggccactcaccacatacggctttcaagcacttgaatgtgactgatccttactgagttacgctgtgagtgtaaaccacacatcagatttcaaaaacttagtataaaaaagtgaatatttcattaatttatattgattatctgtttaaatgatattttcaatacattgggttatataaaatattttattaaaagtgatgtcgattgtgtgtttttacttctctttactgtggggactaaaatattttaaattccattatatgggtaacatttctattgggagtactgctctagagtaagagatttctgggtgtgaaaaggctgagactcactccttgttttgcaggtgagtaaggtgggtcagagaggttaggccatttgttcaagatcacacagcaagtaggtagccaagttaggagtaggccagcatactttcctttaccaaaaatggccaaagggatcatagtgatttttttacatggagtctatgacattgctgctttgggtcaaagccaaaaatattgtgtagaatattagcagttttctaaagccctaagcccaagttgtatcacccagtatcaaatccaatcaaaaatatattaaaaagaatacaaggaagaaaaggaaagaggagaaacctccctatagaagacccagtaagcaatctgttttcattcttgaacagatttctttcacaccagtgccctggtattactggaaaaaagtacattaattacgggagtaaagcacaataagaaaacatttacaaggagtccagccctcatccatcatgcctttccctccaacaaagcaagaatctctttaacaaatacccattaaaagattaagcctaagaataaattgtttcttagtccccaggcagttcatttgacatcatttccataggattagggactccagcaatatgtgtttagcacagggctatagtcacactgcatagtattggtctaaaccattccaaaatatttttttagatctcgaactaataagacttttatgtggctggtaattatactaatatttcacccacaaattgggcctttttccccctccacagtgtgtaaccaaacgcagcaattctgcctttaaaaaaaacgaaccaccacctgttaaaaagtggtctaggaagtatagcaatgtcatggagctcttgaggatgtgtataattgaatagaaaggaaacctagcatctggcgcactcagttcttagtcccttttcctctgagccatcatttctcttctgataactgtatttggttcttataattactgatactatgatgtgtggagtttaaagtacccaacagttgtataaggcttgttacaaacaccttcaatgtccccactcccctcccttcactcttgatttctttttgatttcctgctcaccagggcaaccacattcaaatcttttaactgattcttttgtcattcacctcctccaattcttaaatcacgtgcttgtattggtttttttttttttttttcatttctaaatattatctagcattatttcactgtaggaaatgacagtttgtcctttcttccccctaccccaacccctcccatagatgcatcctcgtaatcataattttggacagaacaatttagtgtttacatattaagattatataagtgccatttgaagctgagtcacctactcttttatggttcttcttttccagtcacttttctttttccctggagttgataatgatgcttttatagtatatttattgtttttgttgttgttgttgctgttttgagacagaggctcacattgtcgcccggactggagtgcagttgtgtgatctctgctcactgcaacctctgcctctcaggttcaagcgattgtcctgcctcagcctcccgagtagctgggattacaggcgccagccaccatgcccagctaatttcttgtatttttagtagagacgggttttcaccatgttggccaggctagtctcaaactcctgacctcacgattcgcccgcctcagcctcccaaagtgctgggattacaggggtgagccacgatcgtatttcttgttttaatgtccttcttacttggttttttatctccttcactaattcatccgccctgcctcactctcctctcagtagttcagatgccataggtgtgatgagccttgaagcaagagcttctacctgcttcggtctgggcttcagcttggtgcccagctatgacctttgttcactttttctctccttcgggtgtgagtccctttcctgaattctggccttaatggaggacaatttccaatagcttcctgagaaagggtaggggggaggcaactttattgagaccttgcgtgtctgaagaatgtctttcttctttcctcatacttgatagattatttcctcatacttgatagattatttgtcttactgtatgattttagacatggggtaattttcccccagaattttgaaggtagcactccattgcattttttttcagtgccattgttgagaagaccatgccattccgatctttaatcttttgcataaacctttgtttgttgacttattgttccctggaagcatttttttattccccagattctgcagttttacagtaatgtgccttagtctgggtctgtgctaatcctgatgctctttcaatctggatattcatttcctttcattctgggaactgtcctcctgttttcttcattctttctccagaactcccattattaggatgtaggtccaataattatctttatttttcacctcttaatattttaagttcctcttggagagattcctcaaccttttttgtcagcacttcttttttttttgtttctgatatcatacttttaatattcaagtactttttttgttcgacttgttcttcattatagcatcttgtttttgtttcatagttgcaatatcttatttctctctggatgatatttttctttccctgagttgtctgttttccccacgttgcctttgtctggttttggtctttgttttgctgtctgccttctatactcaaacgtctggtgatccctgcatgtctgcccatttctgagagttgatggacccctcaagcactgaaggcaagttctccgtgcctgggtgaacgtgctctctagggtggcctgcccacacatttccttgggatgccattgggtaaatatctccaggtcttttgtctttggctgcttagattcccaagagatggttgactcttctagtagccatcctggagggtagattctagctgccaacctcctaggagcacagtgggagaagaaggggtagggggcacagtgagcacagtggtcaacatatgcatgttcttttaatctttcatataatttccgttaattccacctagtcattttggtaccagaggataaacttttttttttttttttttttgagacagagtatctgttgcccatgctggagggcagtaacataatcttggctcactgcaaccttcacctcctggattcaagcgattctcctgcctcagcctccctagtagctgggatcacaggcgcgcgccaccacacccggctaatttttgtatttttagtagagacgggctttcaccatgttggccagcatgtgggtctggaacccctgacctcaagtgatctgcccaccttggcctcccaaagtgctgggattgcagctgtgagccattgcgcccggccagagcttaagcttctaatctgccatggtaggggaggagccgtgactcgactgtccagattttcacatgtaactagtgacaccagtccccaatcctttcacggattctgccatgtgaatttggttatatcacatctttccttactatgagtttagaattccgctttcttgggtttgctaagtaaattaccaccggttcttctgctttcaagtttctggtttgtttttctttctttttctcccctccctccacccccttatctcttctggtgtctttgtccttgtagatttgtgccttcttaaaaatctcttcactgttactttagaggatttgggggaacgagaacagagctaaaattaacttcctcctctgatgaatgttgacagtcttcctgccatagggatgttgtccaaaatacgtgttcatgtgtatgtcaaactagagcttctcaggaggaaagctctttgtccattgaaattgttgtcactattgatagtctttttacccttagaccagtacaacttgagtcacacgtgtggcccataaagattcctgtaaggtcgtgcataagggacaagtagttgtagctttgtattcgtgtccagttgatgaaaacaaattgctatatctcctttgttacaagaaatctatggaagaatctggatagaacccagatagttatatttttgtttttacactgacccctttaattcaataaagacatcaatatgtgaatacataataactgacacatactactatataagtgttcattgatattgttatatgctgtttttttttaataatacttgtaaattttccaagagttttatctaatgtttctcaaacccagctgcacaacagattcacctggtggtcgtttaaaaaaaaagatttcatttcccaccttgggcctactaatcttcagggtgggtgcagtagcaaaacagagcttccattttctggagaagaagtgagacattttgagaaccccgttgggagggtcgtacacatcactgatggtcatttagaaagacagcaagatgaagcaaggagccagctctgagagctgcggctaaaagcaaagcctgtatccacagcaaatagataaatcaatatacacgtgtagtataaatgtatagaacacctggaaaccaaggcactatgctgggccctccttctgtacagaacacttaggcagtatgttgccccctttctttatgatgttttgcccctttgtttcagtcagattttacctggataggaggatgagcagaagaggctggtgtggatgtgcattttgttcctgctctcccagtgacagacattgaagtgttggccggagctagctaagaatttactttagacaaaatcctgaataggacccacacaactctgagacggattacatttaaaaattaatcctcggccaggcgaggtggctcacgcctgtaatctcagcactttgggaggccgaggtgggtggatcatgaggtcaggagttcgagaccagtctggccaacatggtgaaaccctgtctctactaaaaatacaaaaattagccaggcgtggtggcgcacgcctgtaatcccaggtactcgggaggctgaggtgggagaattgcttgaacccggaaggtggaggttgtagtgagctgagattgtgccactgcacttcagcctgggcaacagaacaagattccatctcaaaaaaaaaaaaaattaatcctctttcagtgtcaggtcccatttgctaatggggttcaattttcattcatctactgtaaaaccaaacaattcttatttgcagctgagctaaggggcagaaaaaggaggaaataaaaagcattaagttttatttccatgtatgcaacccagaaggttctaaatggttactttatttgagcaacttactttattaatagcaacttcttgtttaactagagcagtgttggaaaaataatttaacagaaattttagttagggggctacgggaggggtgggagatgaaaaactgaagaatgacgaaattcacatccactaatgtttacatttttaaagctttaatgtctgtttttaaggaatagttctttaatttaaaaaaaaaaaaaccttaacatattctctgtatactctagtgttggaacaatggtgactgatatcggagctttcagttggtacagtaataatagctaaagctcacccagcactaactgtggcagatattgtcctaagcactttacatctgctagctcattttatcctcccaagagccctttgagaagtttctgttattacctccaatttaagatgaggaaactgaggcaccaacggcaagcttgctcatgagtggtggagctcccctgttcatttaaccatgttgctgtattgcctggtgctgcttaccacaggtgcctggcccataggactttatgtcctggactgggcaaggttatagaagatgttttagttattagacaaagaaagccatgctgttccttccacacaccatctcattcaaaaccaatggtcactctgtttgggggccactaggagagatgaggttcagagaactccagtaaattaaggtcacaaggtcacacagatgaacagtggctaccactatcagctaggattcaacccaggtcggactctacagctggtgggatgcctcccttctcttagtatatgtgctctgttttgccgctcaggaggcaggaaagaaagatcaaggatgagtaggtgcctgtactcctagttaccttgcgtagcgctatgtgactcttacttgtatttcccaggcataaacctggctgcatggcaaagaaagccaggaaggcagcgttctccttttttgtgtagaagaaaatactcttgcctcagcagcagagaactgtgtccacctactgtttattttcctccccctttttctttttttcttcatcaaaaagatatgaatgctgagatcatcccagagaaatctagaataaataccatgagaaaatagtccctctggaaggcgtcttgtactcctgctgtttgtaaatgtgaaaagctcagcaaccgggcagctggatgggtataaatatagcccacagcactgacgcccgctgaatcctgctttcttagaggcacaatgggaacccacggaagtcagagaaggagcagtaaagcccagtcgatcaatcagcctctctctttctctctctccatcctggaccttagtgtgggcgtgaggatagaagcagctttaagagtgcacttaaaatagctcttggaactggacattggctaagctcaaagacaaggaagatgcttcctatgaaaccgacctctgcctgacccttacctggggctattttgaccattctggtccgtgatcttagggctgtgttctttctcagttcagctgcttgggcacaagcaggttttctagtgcacgctccaggcgtttggcgcctctctgctgcctccgtactcagagatcttattctaactagactcagctgtctgaagcctggtgattaaaaatagcctcctggtgctagctgtggaatcaagggagagatactcagtgagcagagaggtcagcttgacgcaagacacctgactgtcatacctgtgggtttccttgcacctgagttttttatctcttgaggtattttccttttatactctatcagtgcccattttttatggctatgcaagataaaccagtcatttcagatttgtggggattagtagaagtctgcattttggcaggagaaaaccattattttacttggtggttcccagaaataaagtctctagttatcattccatgcagacatcaatgagatttgccattgaggcatacatttatttgttttctctttctcatttggtggtaaatacttcaaagtaaagaaccatgtcctctacttccgttgtaactgcccacaaaacttaataattcatcttacatgtcttgttttgtgaccgttgaactgaccgtaacagcctttctctgatgtccatggcatgccattagtaagagtcacaaatactgtgatactcgcctaatccatttttaaagtctgttcagggatagtctaagagtacaaggcatatgtgcatatttgcttttagttgtttcattcaatgtaagctggatctgtgccttacttttaacttctaagattgcttccttcaaattggacctcagcatataatatttataaaaataaagcaggaactgttatttggttaaagcagaatatacttaaaatattaaacttgggataacttagagaaagccctgaagttgaagagcttggggctctgtcagtccgctggtggccggagtgccccagcaccgggccttcctcacaaaacattctgcctctgattccctatccttggaactggtgcccagttagcaaagagcaccagctgttctggccttggggacgatgcatggaggaggggcaccctccaaggaaaccaggccaatagagccaaagtgaacaatttcagtcatcattgggaaccatgatagattatgtagcactttaatgattgatttcctaaaaaccattcatgcagtctttggaagttcagcttgtcacttactggcgtgccctccagggcttctgtccacatcgatttcaccactacatctccacccatggaaggcatgggccaaacccattcatattccagagaacaaggtgcagtttccatggtatacagaaaggtaatattgtacagtgggcaataacattccagttccggctctgctacttcctacttctgagcaacttggaaggttgcctaacctctccaaagacctagataaaatggggttaagaatagtgtccacttcatagggtggttcgaagaaataagtgaaaatataaatgtaaaacacttagtacagtgtctgtcacacagcaaggactcagtaaatgttagccaagaggggaggaaggaggctgccacccttatctgttagctcagcttcaaaaagcctagcaaaataacatcatgaatttgatctgagtggtcacagcaaatccattccctcactgatgaagctcaaattaccttggccacattctttagatttttccctttgcctctgaatgaagcattcacttgacgtagataaaatacagacacctcagcctccagttcagccactgtccagtcaagcaggaaagtacattgtgagtgagtcttaagtgaaaaggactagttatgatgcatttgagacaagaaagtagatcgagctttaggcttttccttttcttgccggaaaggaaaaaaacaacattgcattaatcatcatctggtcctcggccaagattcgtatttacctgttatgtgccatattcatactcaccctgtaatgtggcagcctcgtgccatttatcattccaacagcccataacagatgaggagacacagatgacttgtccagggtcatcaagcttgtcaatggcagagtgaatgttggagctcagaccttctgactctcaacccaatgagatacaaataaaatagtggaaaccaccagccagccctcccaagtgtttaggggcattaaagacactggccatcctaaaggcgcctcttactcttatacatcatctaccactgaaaccagagcttccgctgtgcactgtccatgcgtggggccgatcaaggacaccaaggctgtgcaatgacaggtttcttctctataaactttccttgtctctttcttttaagacattgaatagcactaagggataatttcttccttttcttttttttttttttgtgtgtgtgtgtgttttgatttttgacacaggttctctctctgtcacccaggctggagtgcagtggcatgaacatggctcactgcagcctccacctcctgggctcaagcaatcctcctacctgagcttcccatgtatgtgggaccacaagcatgccgcaccatgctcagctaatttttaaaatttttgtagacacaaggtctcactatgagctaccatgcctggcctagggtaatttcttaaagtagagctttatctccttgtcgagaggcatttagatgtcctttcttcaatgaaagattctttttctcctctaaagaacccagaaataatttgttggtcctttactatgatgtccctaacagatctaatcatgcctctccattttgagaccattcattctttcaaacaccattatttttattcagacagtgtacctagcaatagtcccggcactgggaacacagaaatgaaaagttactctctttaagaaattcacagttccaaaacctcggctgtacccacagagtcagggtcatagggaagtttcagtaccagatagtgggaggagggccagggctgccagtcgttggtgaatgtggtaaggtggcaggctgttggcagttgagagctggcatccagcattaaccttagaaacaaagagctcaaggagcagaaatccagccacagagactgggattcggtcataggacttctgttattgagaaggactggaagacagagctgggtaggaaccaagataggcatcccattacagcaaaggcttgtttttaggtggcagacaagggcacagaaaagccagcaggagtgactcaatactggttccctgaaccactggtcccaagcttcctcttgataaagggtaggcctggtcccggagtctgggtggagctgaacttcaaagtaaaggagggttaagtaagcctaactggaaaggttctgggccgtaggggcagacagccaagcatctcactgcagctaaaacccaagtaaaataaataggacttatggtatgcacaaatctctcataccagagaaagtggacattccaagtttgtgtgatttgaaggaaaagattttagttccgtggttcttgtaggttgttactagattgctagaatgcttataatataagatagttttgtgtgatgggtttatttgggaatgtgatgatagaaacaaaaggaaattcctttgttttttattaccatacaaggataagattttgagattatctttccaaggaaaacttatcaactatctattatgtatcaggcacaatcctttgtactgggattccaaagacaaataagatagttcttgacctcaaggaacttgtaattcgttggggaagacagataagtaaccaacaaattagaacgtagggtgattggagtgtgtttcatgtcactgcgccacagaagagaagcagttgacttaggagaggagaaagtttaatttgggccatgaaggaaattaaaagtaaagacctccaaattggtgggcagccattgaaggattttaggaaagtgatgtgctgagggatggattataagatcgggggcagaaagaccagttacaagggaaaatcatgctggtcatgccccagtacttacatttttctcataccacctcttagagcccctgaaagtgtagactccactatggagaagcaacacaaatgtgaaatactagcttgcgagccacgtgggtagctctttcctcttcaggaaaggggaatgctagtgtctagaagtgggagagattgaaatgattctgtaatgaggaaataagttacgttagggcacatatataaagaaacagcagaaaaaatgtaaaatctcaatcactctgtagccatgacatttataaaaatgaaaattttacaagagtatttctaaatgctttgaagttggcccccaaaaagcctgcctaccttcactttgagttacaaataaaatccctagtgttgcatagctgtgtgagtggtatttacattctcacacatttcagatctcttgagtccattttgctagtatttgttttccttggagataggagttaattcagtcacactttcttcccctgacaataactgcatttttttctctaaggtagctttccctccaaccgttgcttgttgttcttacccaagacccagtatctgccaaaacaaatgtatgtgagtgataaacgctgagaggaatgtctgttggaccacaggaaatttcctgttcaggaagagatcttgggaacttcctgtggaggagtgcattgtgggacttttggctgcagtcccttgaccacagctgcaattaactaaaggcagagggggaggggagaggaagaagaggagacagctacccacagacattcttatccatgtagcccgaggagagaatgggctcatacaggttcacaactttgcaagtgaactagatgtctagtgcagaacaagatcactgtgcccaacctcctttactgccatccatctttcacagccttcccggtgctttcctagggctcctaaaaacagtcactgtcacattatccatgtgcattccccagtccctcataagcacacatgaagtgtccatgccctctgtagccccaccaactgtttggaatctcttgattagcttctagaatccaggcattggagttggtggtctttctccatcccaacttaagtatgaaagagaggagaggagaacccgtggctctttgacataccttcatgtgaccctaaaagcattagggaaacgttatggaactgttacgaaaaaagaggttaataaatccaattgataagcacaatcaaaaccaacaggagaaccatgcattcttgtgctgcaatgccattacgaaatgaagtcctcgttaatacctcatactccccttcttggtccccaaactgggcacgtctactttgcattcaagtgcctgatgtgtgtgcgtgtgtgtgttttattttttattttttatttttttgagacaacctattgcctaggttggagtacagtggcatgatcactgctcactgcagcctcgatggcctgggctcaagtgatcctcctgccttagcctctgggtccctgggacagacaggcataccaccatgccctgctaatttttaacaattacttgtagagacaaagtgttgctatgttgcccaggctcttgatgtttctttacagccttcactcagtgcttttatggagtccatctctgaagagcagggcttatatttgagtttcaaaaatctaaagtctcagctggtggcaatttacatctgataatatatatgaccttggaagtctctggcagacataggaaaggggagtggacatctaaggactgaaaaatatcccaggccattttctgggtcatggaaaagtaacctgaccttcttatcccacctcctattcatcatccatctcacctcccatccccatcacattttaaattttaattaatttttcattggcagataaaagtcatatgtttatggtatacatacataaaacatgatattttaatgtatgtatacatgtggactggctagatcaagctaattaacatagccattaactcacatacctgttttttgtggtgagaacatttaaaatctaccatcttcataattttcaaacatacacagtgttattaaccataatcaccgtgttatacaacagatctcctgagcttattcctcccatctaactgacgttttgtatcctttgaccaacacctccccacccgcatcccttcttttactctgcttgagttcaacttttagattccacatgtaagcgagatcgtgtaatatatatcttttcattactggcttatttcacttagcataatgtgcaccagattcacccatgttgctgcagatggacttcaaaatgtaaaatattcttcatgagaatgaagttacccccccagaaagggggaccagttactccccagaaagaattaaaaagtagccgggcatggtggcacacacctgtaatccagctaatagggaggcttagttggggggatcacttgagcccaggagtttgagaccagtctcacagtctcagcaacatagccagaccctgtctcatatttttaaaacaagaattaaaaagcaagaatagtttgcagcaaacattttctgagacttttctagataatactaggtttagtccgccctccaaagtagtataattacatcatggttttaaaattaaaagcaaaaatataggtgaagcaaaagtgagctttattcatcgaaaatttgtcctcactcatcccatgtgactttttaaagtgtaattctaaggagactcccagcatccggatggcaaatacgtgaacagagaaacataaattaactggaagggaacaaaatagacctctcagctgaccaattctttgtagctttgacattggcctttaaaagaacgaggcaaacttttttaaagaaagttatctaatttaatgcaagaggtaactctctggctatgacttagggtaattaggcctattttctacattttggacgtgtttcctatggctggaatgtaaaagcttatttaatattgatgtaaccccaaaatttaagtaattggaatgcactatttctatcacattctattgagctgaagtataggttgtgctctgttcaattcaggttgtcttgacaaagactgagaaatagaatggccctccaagggcatacctgactattctgcggataacacagtcacgcaggcatttgctatagtgaaaatactgttatggttaagctagtggtatcttgtatttcaatgataccttacggtttaccagttttcatgtaatatattaacctatctcatttaatcattacagtgttccttggtgtacagatgaggaatcaaactcagatatgacgaatcaaactcagataggctaagggtggaggtagaccaggagaacctgcacccgcatgcattcttctcactgcaagttcaggcaggccaggagatgaaagccagcatgagccagtgaataagcaattatctgacaaacccaaggccagcagaagtaagataacatctttgttcccctccatttcttcctatgccatccagccctcaacccctgctaccttcaagccctgttgatactcacgccctcctgcccacattccttcggtggggcactgaagttttggtggaggggagcagagcgaggaactctttgtttgtgcagtaaggacttccttacaggaaatttcctgtgatggaaactctggggaaacttcctgttggttaggccactgccgggggctgataacctgaaccacttaaaaccttcagggctctgctgctgagaggatgggatggcccttccctgcttctccaagtctgggagggcaagaaagtccaagcgtacagaagcctcaggaatctccctgggatggtattttccaggagctaaaagctatggctctcatcagctgatcttattctagaagaccagccctcatggttaaatggactgcttagatttataacgagaatggtacctgcagcgacatactagctggatgcattaatagggctttggaaaccatctcaaagttctgggtctggttcttcatacatcattttaaaacatattcctgttatattactctccagtgttaagggtttatgagcactgcaaacatttattttcagctctcacttatgaacttggaattctaattaatccttgtcattgtcagacatggttgacactgtatgctgtgtgggtcacttagcaccaagtgtaaatcatctggggtatgtcttgcaggacgaccaatcttaagccatagcacaaaattcttaaatagactttacaatcatttcacctagtttggacttctggtggattattttgttctttgtcagcactccagcaaagataattactcctaaatcatgccttggattgaactgagctttgaatgtctccaatgttgggaattccgtaggttcccatagcagctctcctggcccagctcttagtttgaaagtttggtctcctaattagcctgaattttctctagtgacctataagcccattattgtaagccctgtccttattgtgtcataaaaataattgactccttgtcttcaatctatttcatataggtagacagctgccacatcaagaacgtcttgtaagtgcttgatttaccaaagtccatttctccacaagtttcttcatagttgttttcctggattgggggttattttagccttactttctaaaatgactggatttaatggaggcctctgtcagtcccaactctccaaatttctgccccagcttggtgctctttgctttgtttatagtaaataatcatttcagcatcagaataaatcagtgaactggacatgtctttaggtggacttttgagattatattcctggtccacattgcaaattagggaagaatgaaagaaattataattaactaggaagaaatttgtccgctgagaagtctcccttgttagactcctagaaaatagagaccataatattttataattttttgtcacagtttccatacatatttgttgaatgaatcctaaaagtcaaaagggagctgcttattggatttgagttgcttctagaacatgttaaaaattatgtgaattttctcaatgtatttgtaagaataagctgtcctcgtgattgagtattgatcttcaaaatggagaattatcagtggtgagtgatgctgcatgtaatgtacttataaaggataggaaaaatattttgtaaaaatgccttgggataagctttaaatataaaaatccaaaatggtgatttagtttggggcactcagaggaagaataagaatagggcctgtttaaattttttgcaacatgattactcctggttttacatttgattttgtattatagaatgagattaactggaatatgttataaatacagaaagtctgtcattataaacactagtcagcaccttttgtcttcataagaataattgctattttcaatgcatacttgctctaaaatagaccatattgatgtcataatatgtagactgagcaaaaatattattagtatcatcatcatcatcatcatcttctgatcttcatcaaagttgtattaaaatattttggtattctaaatatcattatcttttttgaaagcctacttagggtaatagaaggatcaggaactttggactctttgacagatttctagttttttctatttttttgctattctgtaaattctttcaaaagatttttatcaggtgtttactgcatactctgaagtgctgggatatatcagtgaccaaaacagatatgacccctgccttcatgttgcttacagtttaataggggagataagtgtctaccaaggaattcacactagccagagagcacattgcccacacagcatccagagtaatctgttgtaagataaatcagactgttacttccctgtgccaaaacctccactggcttccagtttcatttggaaaccttctgagttctcagtatgaactgccaggccctgtgtgatctgaaatttgtaaatctcgtcaacctctccaccctcatcctccatcaccttgtgttctgctagttcctcttcagccaccctgatctttttgctattcttggaacacacaagtttatgttctacctcagggcatttgcacttgctgcccttctgcctatgaagctgtttctccagatactctcatgttagagtccctcaccttatccaggcctctgcttaaatatcacctccttagagaagcttccccaacagcattatccaaacgacaccttccttcactctccatcacctttatcctgcactatttttcttcttggcaattttcaccacctgacatgtaattttttaaaacactggatggtgacccttaggtatctattcaaaatggccattcttgtgcacagctggggtatgatgccagtgggtccacctgtagggtaattggatgggcctggctgtctcatgggagactccagagtcttttcttttgggaaggcaagtttgtccaaaaagaaatcctgtgggctcctccttagaaagagtcaatatatgatggcacttgagcttttaccatgaagatttccactgagttcccctatattccagagctgctcacccttgctccctcctgaacttggcgttctcagattcatcctgattccagcaagggaaatgtcctttcatctgcaaggaggtgcaggttgctgggctgggggagggtggaatacagccatgccacagatgctttattagtcttctctgttccctgcctgccttcagaggcacttggaacccccagtttctgaggttttatgaagttctggtaggaaaacgagtttgtttattggtatctccccctgcaggcagattgagttaagattttctgctcagctgagtcagataccaattgtccgtctgttccagcttccaaaattttgtgcacctccctcaactgccattgtttcctctcccattctgttgtcttgtgggtttgtaccttttttattcctctatctggtttagtgggacgtcagacaggagcagggatagacaagatatgtctcatcaatgtagttacatgtggaggtaaaagcattgatgtagcagtacaggatgctttgaaagcataaaatacagaaatctggtctggtgtgtcgcatacatttaagaggagacttgaaagctaagtaggagttaattgggcaaagaagaaggtaggattatttctggggaggggaacagagcctgtgaaggccctgagactggaagaggatttgttctacagggaatggaaagcccagcccaactggcattcattgaatttgctgtggaaaagcagagtgacacattgctttggtgaggattgcagatggtgaggtagaacaagacagtcacgttaaggattttgatctttatcctaagagcaacaagcatccgtgtctgtgttacctcagtaaccttggacctcgtaaactctgggttcttttataaaccaggcacagtaatatctacctcacagagctgtgtgcattgcatgacatcatatacacactatattgacttaagactgtcatatttgtttgctcaactcatggatatgaagggcagactgtataccttgtcaggtacttttttctttttattgtatcccatgggggaaatggatggtagattggtggaggtggctagaattgtaaagaaaaatatgaaattcacatgaaggctggagttactcatatgacaacaacagcttatggggcccaattctattgctcttgcgtctgtcacacagttgaggttttggaatgaactacgtatgccatccttgttggacagtgacaagtcactgtagccccctaggagaagaacagtataatcaagatgtcaggttgaggaataatctttgtgatcaactgagtgaaaggtacaaagtaagaaacaattgagaggcattgctctgggcccaaaagtctagtaacaggcaattagaggttaaaggataagcatttgatagtgttctagctatactgcaaaatgaatgctgcatgaaggctaactgagaagcttatcagttggtagttgggaactaaagaggaagcaggcaccaaggaaagatggaaagttctacacacctttgttagttacacatggaggtaaatgcattgatgatgaatctgccatttttaggttttcatgtttaaaaagtttcctgacaatgtgtctagcaatgtgctagacactgtagataatatacaataaaatattaaagaggcggctcgtcctcaaggaactttcaagcattcatacatttctgtttgattgtaacatatttattattttaaagaactggccagagagttgcatgttctgtgtagggataaatagcaagtttcaggcccctgcatttattggcacttacgtacatggtagtcctcacacctttgccggacagcaccaaaaatcctgcggagctcaactctgtgacctcaccctttgagcctggaaatcagcatgaactcatgatctgacaatcccgaacaagctaagcatttcttaaaagaaagcagtgacttttaataggtctcactgatggtgttccaccgattaaatcagtcaaacagaattgtcacattgaagattatcttgggtttctagaattcattctaggttttaaagatgcagacagattctgagggtcacaaacgtcagtttgccaagtatgtttaggctgtaaagttatccatgaaaagaccgtgtggtttgcatgagattgattgtgatcggatgtaactacattgctttttacagctcagtagaaaccactttcaattgcaaattgtagcagaagcaggcgtctacttaattttgatcttaaagaatttcaaagagaataaatgcacactaaatagtggtggattttggtagtatacgccaacatcactttttatttaacacatgcagaaatgtgtactggtagagaaaattggtagagtgaattaaagtacagacagatccacattgactttaaatgaatacatgcacggtcagaaaacggtaaccctgggcaggaatctttaagttttcagggctcattagacagtgagcaggtgaggctcaaggctgagtttgcaactgtgctgtgaaaactcaaaaatgaaagtttttttcatttctgagcctgttgaaaagtgggtaagaagggaaagggcagtctcataataaaataatatgtaaaggctaaccaaataacccactttagtctttacttactggcaggcagcaacatgtcctatttacagagggaggctttacctaagtggttatatgtaaatgaaccaccttttcaatgaaacaggatgcacctgtctagaggtgtctgttactagagcaatggatgtttgattggactgacaaattttatttcctttttggaaaaaagaatgtaggtggtatcaaatcaccctttctcctggtaacaataggaattacttcttgaacttgagaaaccagtagttgcttgacctatgttttttgcatttagcatagtcttctaaagtagtaggagcatacgtttttgtctttaattccctgcagaccccttccccaatgatcatcagcaatacatccacccataaatcaatgaaatcataaaaaagaaacataaaattcacttgaaaaagaatacctacaaggcattcctagaattctcaatgtaagtcattttttgccagcaaagctaattgttctcaaatatttgataacaaggatggcatacgtagttcattccaaaacctcaactgtgtgacagacgcaagggcagtagaattgagccccataagctgttgttgtcatgtgagtaactccagccttcatgtgaatttcatatttttctttacaattctagccacctccaccaatctaccatccatttcccccatgggatacaataaaaagaaaaaagtacctgacaaggtatacagtctgcccttcatatccgtgagttgcacatccgtgattccatccagccacagatagaaaatattcagaaaaacaaaaaacaaaaaaaaaaaacccacaaatgcaacaataaaaaaatacagactttcagaatagcatataacaactatttagatagcatttacattgtattcgttacaagtaatctagagatgatttaaaatatacaggaggatgcacataggttatatgcaaatatacaccattttatataagggatttgagcatccttggattttggtatctgggcggggggtcctggagccaatcccttgtgtatgcagaggaatgactgtactggaaagcaaagtaaagctacaccaaagagggtaatagcaggctataaagtactgagagaaactaagagaagaaagtgaggtacctctgacaaaggagtgcttggaagagaaaggatgaatagaaaaatgggatttcagggaattcattgatgacaggatgacctacttaaaaatgacaagggccatgtgtggtggctcacacctgtaatcccagcactttgggaggccaaggtgggcagatcacttgaggtcaggagttggagacgagcctggccaacacggcaaaaccctatctctacaaaaaaatacaaaaattagctgggtgtgatggcacgcgcctgtagtcccagcttcttgggaggcatgaggtgggagaatgacctgcgctcaggaggttaaggctgtggtgagccgtgatcgtgccactgcactccagcctgggtgacacagggagaccctgtgtcaaaaaaaaaaaagataggaagtgagcaaaagagaggtcatagataatggcatgatgaaacagaggaaaaaaaggataagaaggaggaagaaaaaatgtacaataaaacgagaaggaaggatgcaaaatgaatataggaaaaacaagagaactgaagacaagaggaaaaaaggagatggtagaagggaggaatgaaagtaagtaaaataggaatgaagttcaagatctatttagccatagctaaaggaacgtattatcagctattgatttcctcttctaataaagaggagaatgatatggatagtccagaataatggatcatttgcaaaacattaatgtgtcttgacttaaggtacatgtttataattacctcgaactgtatatttgtcttcttccatgtgtggttttaaattattttaccaaaatggggaagccaggagatacatacttgattcagtaaaaccagctttttattcgtagtttacttcctgctgcatccttttttcggctgagagggatcaatgtctgcaggtgtcccttaatccataattaaaccatatgcacatctaccctcccagtttccctgcccaccataaaaccttcatcttggctattgcttggaaaatggggagggaatagagcttctgcttttttttttttttttttttttttttggagagagtcttgctgtgtcacccaggctggagtgcagtggcgtgatctcagctcactgcaacttccgcctcccagattcaagcaattctcctgcctcagcctcctgagtagctgggactacaggcacgcaccacaacgcccagctaattttttgtatttttaggagagacagggtttcaccatgttagctaggatggtctcagtctcctgacctcgtgatccgcccacttcaacctcccaaagtgctgggattacaggcgtgagccaccgcacctggctggaatggagcattttacttgagacctctgtgagctggtcctgagtatgagtagtgaattccaacccacttttctcctaatccctgtcgtgtcctagagtgagaatatacagaggggttggaagtgggtttatgttcatgggctttctagatggactttcaagtccaagtagaagtccaacttgagagctcgtgtagaaagcccttgaatgtaaacccgtgaagaaaagcacttccttatttcagaaagagcacaaaagaccagcaatccaaaggcatttcgaagaccttgaaagagctgggagtggcttaggtatggagggtgcatgtgtgagtacaaatggcccctcagctcagaaccaagcatctgtgtgccatgatccatggttcctaaatatcatggagggcaaaaagtataaatgtgaattaatgcaagagaaaccacactgaaataaaaaatacctgtggtctcttgagattcaagttggcaaaatccaatctaaaagatgtctgactatcacaattagtgaagtccacaggtcagattttcctctctgttcctgattaggattaacctggaaaggtggattgggtccatctttaataataactacaccttctgaaagatttgaaactattattatctctttgtttgctgctgctttcatagatttatggtaggacttggggttagatggatgatccaggtcacctattccagcctcacactctgcctctattccaaatatgacatcactgagcgatggccacccaccttcccttggatacctctaacaatgggaatctcactgtttcacaggcagctcttttttttttaaacacctccaattccaatttttaaacacctccaatgtccagaaagttctttaaactcttaaatacatgacatttattaaaacaaagcctcaaaccactttcagagtggtggtacagcaaataattgattcttttcagggtttttcccccctgtgttttttgtcttctctaactcaaatcattgcccggatattgcttataacaggagctcagcctcaaccagtctttctgcttttaccacatgctctagtggaatctagattaccggactcatttcgaatctaactaaaaatgagaaatgctctgtttatataaagcttggcaatcaataggaaaaggaaaggctgtttagcaaaggccagtgataattccaagaagcagtgtcttttggaatatgctatggtgacctggccactgcagctatctgcttatctgtctggtttcagatttccagaaaggactcgctgccttcgaaacacttcccagcccttccttgggtgcctggatttctaccattagcagtttactccttgagcatggatttttgcagaaagacatgtagaccagggagatggctcattaagctcttggtggtcatttcaccagagcatttagcatttttaaatcccttcctggatgcttgttttagtgatgatggtggtggtgagatgaagcagggatgtgtagatcatgaagggatgggaaaggggatgatttggttggaacgaagcaaaataacatttctgagtgcctgctaaggtccagcacttttcacacgtaaaattttcacaacaatccctgtgagttgggatccagtttctacagatgaggaaatgaagacaggagactagatgacctgaccaggtcctaggccagtcaggaacagagctgggatttaaaccagagctgcctggtccaaaacctgtgctggtcctgctattttatgacacctagaagggaaaagggcagagaactggaaagctgagatggaatcacctacttaagaattttgcagaaggctaaccctgtctaaaagcatcgctttgcaatcagacacatgtggcagtaaaaatgtcccaatgctaactcattttaagccttggttttagtctacctaaaatttatagaacactgtaaaatatgctacatgtaataagatatttattaggagtcttcttgcacttgttcagaatgctttttattatgtttctgctcattattgtagatattctcccattttggagaaattgaccgcgtgcacactcttcactggagttttgcacaaatcttaccagaaaactggtgaagatcagtcctgaggccccttccgcctctaattccttgcagtattttggctgtactatgtgctgttacactagatcacaataagcagctgccagtttcctcacaggttcccttggggaaggatatgggaataattcttaggaaccccccacaaattatagcaaccaatgcagtaaaacccctttagctcactcctccccctgtgctcactcacatactcaaatatatttagtgctttccttcctctcactccgacacttttgggagagccctgggggtggttgagtaccttgtccttgggtggattttcttgttttctgagactggctgccatcagacttcgggagaggatcttaccagaggcgggtctcttcttcccccgccaccgccctcagtattctttcacagccaccacaaagccacgctttctctgctaagtacacattcctaggactgtaacaaaaggcttctgtgagtttgaaagctgcaggggaggctcctgcgtgaaggcctaagatttaaagggtttcatttctcctgtgctggggactgtattgagtgcagtttgaaatctgcttcaccaccacaaggggaaatagaaatcagccctaaagctgcatggagaccccggctggtctttatcctcatagcttagtgatttcctgccacccaagaggcagtgaggggctccctgacattccggaggccccaggaaccctggctgcggtgacccggtgctggggagggagtgcatggggtaggctcctggttgtgagccttcagttcgccgggatgtctatgctgtgctgtgtggctacttagccaaggctgtgcatgccagccggagccaacagcttcagcaaacctgccctccggggagagtggatttcattgttttcaaagagatacaggaaatcagaattttccatccttccatggagagacttggattggactgagaagagaaccagcattaaaaaggaagtctccttccctttcttccctgcccctcctcaccccagccccagcccacccgccaggggcacaccctccctctgccggcctttgggtggaaaccttcctgcctgcagcacaggcagtgtgaactgcggggctgtctgagcaacccagctcttgccttttcagtagcagaggtaatgtggccacgactcagaattatgggaccccagatgctgaggaagtaaactgacttcttttcagctcacagcagacgcatagacaacagagtagatttcatgttctaatgaaacagtgtagaaactctgtccttggtggctcagtactgtgtggtatgagcctctgcctccctccctccctccctctttccttctcttttcctcccccaccccttcacggcctgccctttcctgattcttcagaactgacaactataaatccagcccaaattcctttaaacaaagggtcaccaagagcacgaccttgaaaagacttcttgtgatatgcacttgcagagttgcatattgttccttggatttaggacaggccaaagaaatcttccactttatttaagaagagcctgtgtggttcgaggccagggccgtggacataggattaaccacaataataatacaatgaagtacacatgcaaaatgaaaacttaataatgaagaactactgattttttccagggagtatcaagcacttccttgtaaattcttacaaggcatgaattatttcctagaaatgatttaggctcttttggaaaagtgcattgattcttttaacatcataattccagttacggtaaaacctccattatctgattttctgtgaattgcaaagctattattaactggtacattttatattttaccagtacagtgacagctgatatttataatggtgaccccaaagttctgtaaaatgccgaattacccactcaggaatcaaagaaagattaaattgtgttaaatagagtttttcatgttaagtgtcttattttattcagatcttgttttagaaagtccaagtgtacatccaccataattttcgagggcagtaccaacttaaaatgttttatcttttcttggctttgtaaacaaaaccttgtaaaaaaaaattttttttttcaatactttgggttcaaactacagatcattcgatctcaaacctgacaggtaaacaaatttttttttcagagtaagtattgcagacatgaaagatcataaatgtgttcaccaaagtgagtgtgagacagatcaccccaaacactctccactatttctctatgatcttagcccagctgtgtgtgttgtgagtcatgcctgggtctgacaccagcattcagaggctggcatagcttagcatccacatcataaagggctcagatcgatggctctccttgtcaagctctgcagccctctctcaggctttgtgagatgtggtttgcatcattttcctttaaggaaatgttatgcagaaacataaatgcagtatacaacgaggaggctttcaccaagaaattaaaagggtacagatgtctaggaatgcaggggttaagacaaaaatgtactgcagggaaagaaatgtgagcagaatgcccctcttttcgcctgcttctgccttgcatccagcccttcccggggagtgtgatgtgaactgccatccaaggtggctgtggtacaggggcagggtctgggggctgcttctgcagcttcagcgcagaaaacccagagctcagtcccagcaaaagcctaaaggagaaggaaacagaggccctaacacaacagaaaatgatgcaccccactttcctgtggttcatcagttcacatacttcccaggagaagtcaaatcacgccccagaataggatacctacttaggacttagtgatgttttatagtcatgtcgaagaaccttcacatccatggcctcatttgatctcacagcaagatgggcatgattaaaaaaaagaagttactcccactttccagatgagaaaacaaattcaaagacagtgagtgccttagctgagtcctatccaagcaaggcagggggcaaagccaggactaaaacacaaggttctaattccttctccatgatttcctgatgcccatcataccctaatagaataggatcaccctgcaaggcaactggtccacatggagagtcctcttggaggacaccgacccgtggtgccacctctgatttgcaagttggtgcattagacaagccctggaatgacagccagaagatctctattctgatcctggccctccgtctacttgggccactttgatcaagccatttagccccgttcccttcaggtggctcagctggaagtaagaatgataatgcccatgcagctgactcacctggtgactgtgaaggccaaatgagatgatgtgtttgagagcactttgcaaactgtggagtattgccagccatttctcctaatttggctcagggcagaaagacatccaggtgaagagcttgatgtgtgtgatgacttaggcttggggatatttgtgaacaggacacaacaaataaattcgtttgacgggcagagggacagtatgctgggtatagtagaaactcttggaacctgcagttattgaagggtttaaaactcaaaaatgatacagaaggcagttctattacagtttctgcttttttgctgttcaacacctctgaagatggtgcgtttaatccttcctgggatggcaggttatagatgacttcatgctgaaagtgacccgtaaggaatatccgtatattttgaagtgtatgtggttcaccaggcagaaaacagtctgccaagtctctcatcccaggcagaaggggtggcacatgcgaaggccagagaatgcagtgcctctgagaactgtcagatgtcagtgtggctggagccaggtctgctagagggtgaggttggaagttaaccaggagtttaggaggccctgggaagcctctgaaaatatttaagcaaaaacagttagctttatgtttttgttgttgttgttgtttgagacggagtctcgctgtcacccaggctggagtgcaatggcgccgtctcggctcactgcaacctctgtctcccaggttcacaccattctcctccctcagcctcccaagtagctgggactacaggtgctcgccaccatgcctggctaaattttttgtatttttggtagagacgggggtttcaccatgttagccaggatggtctcgatctcctgacctcgtgatccacccgcctcggcctcccaaagtgctgggattacaggtgtgagccactgcgcccggccagctttatgtttttaaaagatcattgcctcgttcttggttctcagctctctgatccttttagtttttattggatagaggagagaccttaatgtatacagagactaaggaacttggaattggaaatctgcctggctccctttccctcaacgtgcctgcagtcagccatctttctccagctaagccaaaggatggtgggggcaccacacaacagagagctgagttagaaagggtgggagggaggtggctgaagggtccccactgcagttgacaatttgaaataaactcccactttccttcaatattttcctatagcaaatggaaactttgaccagataccagcttctttccatccttccattagactcacagcccagttaggatgttcacagtcccaagccagggatagcacatgccattaccatagtgggctggatagggggcaggaagcaatgctttccagcccttagaagcctctggtgatgtgctgtgaacatggtgagggaacccgaactttagagtcaaacaggctggtctgcaaaccccggttccagcactcactggactcaggatcttcccaagttagttaactcctctgaccatgtctgcattttctcatctggaaaatgggaacagtaatatccaccctccagagctgttatgaagatgaaattgaaagtgtctccaacgcaccaggtatatagtataatctcaatttatgcttttgcccttagatgccagaagttaatattctttcaatacttattctcgtagaagcaaaagagatcctgtttgtgtgatgttcctacagcctctgctgtactgtattatgaaagctcaagaaataggagttaatgatgaggcacagcaggaagaaaaatgtctctaagatgccaaacagggaaaatttaggaagaaataagaaccaaaaaataaatcagttgatcagggtaaaaaatgtcttatgctctgaacttataactctatggagtaatttccactaatgatctcagtgtctacttaactaatcatgtacttttctagccagaaagacagtacttgtagggtacgttccattttaatgcacaaatcattgttgcttttcaaaaagtcatctttttttccctggccacacacagcaccccgaggcctggccagcccccatgccagctcaagagcatgaactcttaccggaatgggttctgtggggagtacaaagtcaaacataagtaggcttgcattcagagctcactgcctagcgggaaaaaagacatatgcactcataactctaatttaacacggcgtcctagaaattccatatccatcttcaaagttctctggaagcaaaaagacaggaggaaagacatttttagaaggaggcttcctggaaggagtgacttcagtttcaggccttaaaggagatgtgagtttccacatgcaaggagggaggaaaagcatgttgcagacagacgaagcaagtgtgtgagcaaaggcctgcggggtgacagggaggggtgttgggaggtgtgtatctggatgaaggcaggtatggaaagtgctgggaaaaaaggtctgggaaagggccttgggggccaggtgataaggaagttgaatgcctctttgaagagtggggttttattttatgtgcctttggtggggagttgtgaaggtttttattcaaaagagcagtggggctgggcacagtgactcacacctgtaatcccagcactttgggaggccaaggtgagcagatcacgtgaggccaggagtttgagaccagcctggccaacatggcgaaaccccatctctactaaaaaatacataagtaacaaaaattagctgagcgtggtgatgcatgcgtgtaatcccagctatgcaggaagttgaggcacaacaatcgcttgaacctgggaggcggaggttgcaatggcctgggattgtgccactgcaccccagcctgggcgacagagcgagagagactctgtctcaaaaaaaaaaaaaaaaaagcaatgggaatggttcttaaggaagatttctctgggcacactgtatgttctcactgaatatttggtgtggtttgggttttataccagttacgatatggggcttggtatctctgagcctaaaatctgtgctttccaaggacagtagaaatgctagtgttcactttgctcagtactcttccctccacttggcactcatgctgcttctcaagccttggggtgtccctggttctggagtccctcctacccctgcagcccttttctaagctatagtctcacccctcctctgcaggctcccaggcagcctcacctcctcctgcagagggatcagctgtcaccctgctcctccctcctggccctcagcctaccctacccacatgcattcaccatcttaccagtggaacaggcgtccctctcctgtatacagaggtcccttcccctgagctcttctgcctcagcctccccagtgggcttctcccctccttcacagtcagcctctttctcatttgcacctagttccattccatcttcaaagaagcccacttggattgcacatctctcttcactaccacaaatctggttcctcacagccaagttctggaaagagttctccacatggtgtcctcctcctcacctcccattagcgcctcaaccctccgtgatctggtttctacgcctgctgcccctctgccctggctgcagtccccagatgccgaatccatctgccatctgctgcccgaaactctcctggcttgcaagataccactgtcctctgacttgtccccggtcttgtcccctgctgttccctcctttaagaatacaccttttctaaattgcctgctgcctaaatgttttcctctggaaaactcacctactccagcggcttcaacgatcatcagtgcgatggggacttccaaatattttttatctctagcctgggcctttctcttaaataacagatgcatgtgtacaactgcctactgggcctctttacctagatgttgtacagttacctcacattcaacaaagctgaatatatcccccgccaatccatcctctgtgggatgagatgggcgggcccctctattcatctagtttcaggaatcaggagcttggattttgtcattgactgcttcctccacattgaattaatctcttaagttccatcaattctaccccatggtatcttcagcccatcctttctccatcccttctgctttagttcaggctaacaatatctgtcatctccatttctgcaacagcctctgactggccgccttgtaccagtcttgccctgttctaattcattctctactctgcagctggagtgatcctttgaaaacaatatccgattatgttacgcccttgtttaaaattcttcagtgactccttgtagccttaggataaagcctgaactccttagtacagcagacaaggccttccaaggccttcctaataatagctaacacttatgaagttcgcaatccataccccacactgttctaaggtccttacacatatgtcaacatacttaatgctcataattcctgacgtaggtcctgttactatccgagttttacagtggaggaaatcgaggcacagaaaggtaaggcaccttgcacaaggtcacacagctaggaagtgggagaaccaagattcaaacccaggaaacctgactccaggcccacactccttagcaccatgctgcactgtctccatcatgtgccgtagcttctcatccattcagaaatattatattgagtactgaaaatgggctagaagctgcttgagacactggggatatagcaggaatccaaacaaaggtccgttcacatgctagtgaagaaaatgagtaagaaacagcatgattagtaaaattattaggtagattagggatgaatgctaagagaaaacaaaaataagcaagaaagaagaccgggggagtctgagaacagatatgcgatgttagaaggagtgtccagggaggacttgaaggaagtgaggatgtctaggagaagaatatcagctgaaggaacagcaagtccaaaggccctgaggtgggaatagttcctggtaggtctgaggaacagcagagaggtcagcgtggctggagcagaatgaaggagggaaaggatgatggcaggaaaggatggtgggagctgggtacagacaggtcaggtcatatagggcccagaagatcattgtaaagaccttggcatgaactgtgagtgagagataggaagccactgggggattctgggcagagtgacatgatgaaacttacaaacagaggagtgatgtgatttgaatcaatctctggcaggtctgttgaggatagatgcagggaaggaacagtggaagctggcagaccagtcagggaccagtaacaatgatccaggcaagagaggatggtggctgggactaatgtagtagcagcagaggtggcggaagtgggcagagctggatacatttggaaggcagagccaataacacttaccaatggaccagaagggggtgtaaaagaagaaacaaggggctgggcacggtggctcacgcctgtaatcccagcactttgggaggctgaggtgggcggatcacaaagtcaggagatccagaccatcctggctaacacggcaaaaccccatctctactaaaaatacaaaaaaaaaattagctgggtgtggtggtgggcacctgtagtcccagcttctcgggaggctgaggtgggaaaatggtgtgaacccgggaggtggagcttacagtgagccgagatggcgccactgcactccagcctgggcaacagagtgagactcagtctcaaaaaaataaagaaagaaagaagaaacaagggcgactggaaggtgtggggccttggccacagaaagaatggagtttgccttctctgtgatgggaaagattgggaacagcagatttagatgagtgacatctggaggttggttggcctcattaagcctaacgtgcctattaagcatcaaaatggagatgttgaccgggcacagtggctcatgcctgtaatcccagcactttgggagtctgaggcaggaggattgcttgaggctagagtttgagaccagcctgggcaacatagcaagaccccatctcttaaaaaaaaaatgtgttttagattagccgggtatggtggctcacttgtagtcctaaccacttggaaggctgaggcaaggggatcacttgaagccaggagttcgaggctgcagtgaaccatgatcccaccaccatacaacaactctgttgtctgggcaacagagggagattctgtctcttaaaaacaaacatggagatgcattgtcacctcccaccctcacccccatttgaacacacactcacatatatctcacgtcctaatcctactgaactactcaacatttccccaaaccggttgtgctcttttcatgtgtgcaggccttgcatccgctgttcctctgactggaaagctgttggcccatccagttgagaaagtcttccctggccgtgcacgaatgcactaacttgtaaatgtctctttacattcctttcttcccttccagaccgcaaaatccagtctcattcaccttgacatgccctgcgcctgatccgggacgcgaggcatagtgggcatctcctaggttagacggatgggtgagtgggtgagtgaacggagaggtggacaaaatgagtgctcagcagttagacccaactgtgttttgatggtagtgatgggaattcccctggcacatggccaggtgagatgatcattcagcctgaaatgaaagaaacagcagatgtcaggaagtttttgttaatcctgccttgtgcgttagaactctcccgcatacgtcccctttcccgcacactctctctacctttctcccccatttctagctcctggtcttattcatctgtagcatcagtaaacatataccctttactgttcacatccaggtctgtaggggaaattttggttataaaaccggaagagtgtttaacctaatgtcctgctgcgggcttgctttccacgggcctccgggtctgttaaaatgatcaggcctcattatttaggaagctgcctcagccaggcattactaatttgggcattactaattcagatgcctattcaggcaaatgagcaatgaatgtaaagtgcttttgtcagtgaattgcaagtgaagagaagagggagtgggggaagtaaagggaaagtgatagaatgtttgagctttgcttcatttccagaaaggacagccattgcttcctggaagctgggcttggcaacaggcatggaggaatgggaaagatttatttccctttgccaaagctcaataattcagcttgagtatttcaaatcaatacatttcttgcaaagtttccaagggctgcattaaaacagccatttttaaaaattatcagtacatgacagcatcctccgacgagactggcatgtcagggatgagtcgagtcttccaaatagacaagactccagtgagaaaggaggctgccacaagcaggaaaagcgaagttagagctgacagcaagaccaaccgcacctgtagggcctctggcgttcacacacctcattggttttgtgggggctctttctgagatgagcagctggatcgctcctcctaagggcttgcatgggggaatctgtgactataactccgtatttctttgaagatgcaattcatcactgaacttgggaaagactaacttggggaggtctccaccacgatctaggattgctaagatgtctgacaggctgagtcactcatacttttgtgaactattaaaaatttcatagttctgacatctggacatcttgactttcggtgataggagatatggaaagacagtaaaaggctgtgtctttactgttgttttaatccccactagagagtcctttttttctttttttttttttttgagttggagtctggcaccgtctcccaggctggagtgcggtggtacgatctctgctcactgcaacctctgcctcccaggtggaaatgattctcttgcctcagccttccaagtaactgggatgacaggctcccatcactaggccaggctaattttttgtattttcagtagagacggggtttcactatgttggccaggctggtctcagacccctgaccttgtgatccgcctgcctcggcctcccaaaatgcgggattacaggtgtgagccaccgcacccggccagtaattccttctatttcgatgtttcatcttcactagaatcgttccttagttctttcggtgggagaagccattcagccccccttgactgccagtgccctttgaggctctcagccatttgattcttcctgtgtatcccctgtggttgttgtctctgtttctagagtgcagtggttcctgcactttgggctgtaaccccctttggtggggccagagaccccttagattaattatcacatttctttcacttactgccacaaaacccagcagcgattcactaggagaacccgaagattggtgctcttctttatgagacaccaaaggggctctgtgtttcccagcatgaagtcttcagtgacagagtctgggaggacagcacaggcagcagcagtgtaactctcagaatccccacggaagagcagagcagctcaatagcaaaaccaaaacccagcgacgagacatccccaagtcccaccttaatgggacttttggtagcctttggaacagggaaaacccaaaaatagccaagaggtattcaccagaaagcctgaaagtgggagtggttttgctcgttcctatagtagtgagggcaagtggcgtcgaggaggtctgaaaggtgtagagttctctgggccctgtgaactctgccactaaccagccacgctgatggccagctttcaggatagctgtggagaagctgctgggagtagaggcacattgaaaaggttagggatggccaggcatggtggctcacgcctataatcccagtactttgggaggccgaggcaggtggatcacctgaggtcaggagttcgagaccagcctggccaacatggtgaaaccccgtctctactaaaaagacaaaaattagccgggcgtggtgatgcatgcctgtaatcccagctattcaggagactgaggcaggattgaaccctggaggcggaagttgctgtgagcctagatcgcgctaatgcactccagcctgagcgacagagcaagactccatctcaaaaagaaaaagaaaaagaaaaggatggggcagcagagacttagatgcaaggtctcccaaaggaaacagaaccaggagatttcagaaagccagctgccatttatttgaatgctacatgaaaacaatagaagagagggtttgctaaggctggaaccatgccatttcataaaaatttcggaacattgtcttcagatgaaaatgagcaacagaaaagtagtgaggtcaaatcccacacaaagtttttataagataaaggaacagaaggagcagaatagcatccctcaagaaagcgtgccaaaacaacatgcctttagaacaattcaaaaccctacttacctccaaatgagctaaaaggtaagaagaaaaagatacgaagcgtggggcaaacacaacatcaatcagaattagaaaaacttccaaatgaaatgacagactctggaaagaattaaaagtaaaagaaaaatcatttcagaaatgaagagttaactagtgagaatacaagatgaatctttacaaaaggtgattttttaaaagagaaacacaagggggaagcaggaaattttttaaagaagaaacaagaaaggttttaaaaacaactcaagaaaaagtgacaaatattgaagaacggcaaagaaatttcaccacgtggataataggagtctctggggaaaaaaccacaaagcaagctttcgcctgcatcgctcctgtctctgcccctgtcttcacatggccatctcctctcctctgcgtctctcctctgtttccatataaggacacctgtcattgaatttggggcccacctgcataatcttgagatccttaacttaatgacgtctgcaaagagccattctcaaattaggtcttattcacaggttctggggattaggacacggacatttctatttggcagccaacattcagccatctccagtcactgagctagtaagtgacaaaaacaggatttgaatttcgttgtttcattttattataacgtggttaagagagattttaaatatttccattaagttagcaattcttgccaacaacagtagaaagcatgcctttttttttttttttttttttaaagtcagagcctcattctgtcacccaggctggagtgcagtggtataatcatagctcactgcagccactcctaggctgaagcaattctcccacctcaaccttctgagtagctgggacttcaggcatgcactaccacacctggctaatttattttgtttttcaaggagatggggctcttgctatgttgcccaggctggtctcgaactcctggcctcaagcagtcctctcacattggcttcccaaagtgctgagattacaagtgtgagccacaggacctggccaacagcatgcttttacaaatagtagggtagcaggaggccagcctgcagaccgcccagagacctcaccccatcttacgctctgcccaacctcaggggagcatttttgcacttggtggattagcattacttgctccatccatgatgagccactcatgctcttcacagattttccagactcccatgtcaaagttaaaaaacagacatcggcctctttccagaactcagaatattcacatctatattgttaacactcataccttttccagcacagaatgaaaagcacctttgaagaatcgtaagccatgaatgatgacgggccgaagggagtgagggctcctacctcttgtcactcctaccatcctgcctccaggacccctgccacctacttgggagtctgcccttaaaactcaagggtcacctgactcattcctccccactcattcatctgactacccaccaaagctaagtgtgaacagcctgtattgatttatcattttccttttgcctgcttcctctggtacagagatcttcatgctttcatccaaacgaatgaataatgtaaaatcccaggtggggtgacagagccaaggagaaaagtgttctgcagcaagggagggcctcccagtatgagccttggagtctcagataagcccagggacaaagcatgagacatccagttacatatctgtggccctggaaggggagacggggttcgctttgtggtggtgtttagctttcctgactccaagtgaccatcttaagccaggggattagtaacctttacaactctaatactagggaatatattaataactggtgagaaaaaagattacagcttttttattgataggtctataaaagccatttccgtatgaatgtcctcagaaaggaggaataaggggatgagatagaatagaatagagagaagtctgtctcacacacacacacacacacacacacacacacacacacacacaaatgcaacacaattatctttaaatagaagttgcttctccaagtttgtttttttttgtttgtttgtttcatgaggcgtcagcaacgctgttaaaatgatttcatcctgcctgtgtgtcacagcagtctgccccgcgaaatgctgaatcagcagcagcccagacagcctttcggtggagggtagattcgacacccaaaggcaaccaaccgggcctttgaaagcacttggaagcactctccaaagagccagggaagaggacaaggaagaagggggtgcagtggaattctccttaaaaaacagcatgttctagaaaagccatgctttggaggtgctgtaggtcagatttgcctttgggtccctatgtgtattttctgaggtctgttcatgtaaaagttcaacacctctttcgcactcccttctcccagcccccgcgccctgcccccacacctcctgtccacctccacctcctcctcctggaattcagtgattatcaggactgtctccatcctgagaagaggctttttaaaatttcgcaggagaatagagacacccgagagggctgggaacaggcacagctgagccacacaaagccaagcctcctccatgcaagtgacggacagatcaggtcccagttcagaatgagaatgagttttactctggttacactttgcacaggaatgttctgcagactgtgccgggcaccagagatggtccgtgtgcggtttaaaagagcaggaggggaaagaattttcatccctctttattcaggcaccctcaggagagtatccatgttctgtgaatcatgcaaatcctgcaggatctttatgttctctgtaccccatccatttctgctgaggattacaaacattcttgcaccaactttcctccagcagtttcgatttctcaataaatctgtttgaggaacatttcaactcttaatatctattttcctactttttttttcttcttaaactcaggcttctttgtaagcatacatatcagtaagtttgataataaaaatgacctttctgccctgcagtataggaaatgctgccttaatgcctctttgctttagaaactcatccttgtatagtatctctccttgcatagccaagttgcctcattgtacgtaaattaaggttatttgcagtgattgaccctaactactatgaagaaaaactttcaatatgttagcaatgatgtctataataactgaagaagggacattccctatttaaggtcaggactgtgcgtttcaaataaagaaatgacagctcaaacatttcattgtacccccacttctaagtgagaagagggcacccttcgtgtctctcttttctgtttttctccctgaaatatcaggagagacatatatctctcttaaacctgatttggttttcgcattacctcacaggtacatattgtcagaactatttgcatacacgagactaaaaaaaatactaaacggattctccagggatccatggataaacttgaggtagtctataagctttgaaatcacaagcaaatatttgtgtccatgtgcctgtgcattttgaaggggggtttgtttatgaactctggctgaattctcaaagaatcctgtaccttcttcctaacgctgagaagtacttgctctaatctcttccccactccctttttgctgtcccctccccattatcttttttctttttgatatggactttaattaaaatgttgatgcttacgtcaccatacattttctgcattaattttgatttttaaaatattgcgttacatgacttaatcttgattactgaaactttttaaaggtaccccttaaattttgctcctggggcaaatgtcttacttgcctcagcctagcctggggcctgagcgggcacctccttcagccttctttcctccaacctctccctgatccaggctgttttccgcaaccccacctgagccattttcccagcctgcaagatgacaattcagtcccctcctcaaagcactgtactgggcctcatagctcctgccagagccgtcatgcaccttccaagaatgcttgctccagcttctgcagctccagggagctgctgaaagtattttggtcttctggagacacgggacaaagtacaactcatctactatccagtccttgtcctacccaaccccccaaaatgcattgagcacttgctctgtaccaggcactgtgcaacatctctatagggatcacctcatttcatgctcacatttgccctaagaggtaagtactattctggactccatcttaccgctggagaaacagattcagacgcgtaactaacccagcgctagtaagtggtgcagccggtgttttaacccaggacaatttgactgcgaaacccaaggtctgatctaaaatgctacatggctctcaccacattgggcttgctacccagaagcaaaaatgagaagaactcttctaagtcacgtttgtgaggctgagcggcaagctctgggtcagttttgctgtcaacaggttttctgctaaaaacccgtttgtagctaaaactagataaaagtcagaaaaatccacaaaatgaagtttataagaaaaaacatcattcgagggaattgactgtgactttggatctgaacatgaacatagagtgttcttgttcttggactttgggctgaaagacatgagtataaccttccgacctccacttggaaacttagtgctgagatacaggctaaccttgaggacagaaataggaaatgttttggaacttccaattccctagtgacaggatttgtttgcagaaagcagctttggtcagatagcacattcaagattacaggcagacccagaggagtgagatgtggagcttgtcagaatgcatccaaggctggcctgggggttttgagcagatttgcagagagcaggccggtggggaagggaaaggaggcagaaaagtctccggaaaagtgcctctgggaagcagcttgaagggctctgaggacacttggttttcttttgaagggcagagtacacagggaagaactctaagtaaaccctgccctcggcaagcagaggtcagaaggtgctctgtgggcaccgagcagtattcgggatctgcagctagaccaggcctgccatgagaagttgagtttatggtttattattcctcattcccttaacatttttacagtgcattttagagtgcaaggggcttttacatccattatttcctttaacccaggggaagttcactgggtaatacagaaagcctggagctggagttttggtcttaggttcattgtgaccttgggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagacaagaacagatgtgttttcttgacttaagacaaatttttaaaatgtagggaaaagtatttatgatctcatgatctgaatgctgagacacaactcagagtcatttgggctgctcttgaaaatgaaatcctgacttatcaactgcatatgacccttattggaataagaaggaagggagacaactaaagaaactgatgaggcgatattggggatattctctgattagctcaatttttaaatagtttgtgtgtgtgtgtgtctgtgtctgtgtgtgtctgtgtgtgtgtttgtttgttttgaaatagagtctcactctgttgcccaggctggagtgcagtggtgcaatctcggctcactgcaaactccacctcttgggttcaagcaattctcttgcctcagcttcccaagtagctgggattacaggcgcctgccaccatgcccagctaatttttgtatttcagtagagacagtgtttcaccgtgttggccaggctggtctcaaactcctgacctcaagcaatccaccggccttggcctcccaaagtgctgggattacaggtgtgagccaccacacccagcccttaaatagttttttaaatataaaagtaaaacatgcttaatagagaatgagaaataagaaagaaaaaaggaaaaggagacagggaatatcacctacaattttactgagtgtcaattctttgaatatttttacgtttcattgtatttttctatgcattgagattattacatatgtacacatactatttttcaatatgaatacatactcttcatcatgttactggctgcattaattttctatcatagatattgtcagtaactattacttatttccttattgctgttcctagtttttcattattaaaaataacactgcaatagacatctttgtgcatgaaagattcttccacatactaagttatttctttaaggtagattctgagaagttaacatttacagggttcttaaaatatcactaagttgtttgccagagagatgatgccaatttatcttctcactgttttgtgagtaccagtctaatgagctccgatttttaaaaagatgtatataatggatgaaaaagcaacttaatgaaaagaaacatataaaggagagtttctgagctctagaattttaaaacgtaagtgagctgaaaaccatggaatacgcttaagaaaacaataaatgtgggcagcaggataagaataagcatgatgtcagcctgctgatggggttggatggggtaacatcagcaaatggcaaagaaaccaaaactgttcaacttctttctctctcccatgaaggagaatgattgtcagactgaaacaggtagtgcaaacattgacagaagggaattgaagcctgagatgggtgaattgattgtaaaagcaaactaagttctgaataaatgcaaggctcttggcccggacaaatgacatcccagggtcgagaactcagaggggtgaaagataagccactggcagtgatccttcagggttgtgggaaatggaagctgtactaaaagaataggaactgttggtaacctgattttaggaagagaagctggggaaaatgtgggtacgaaataaaacagctaacctgatggaacttccagataaaattcaggacagattttcaaacatacatgttacgagtggaagacattatcactttggagccagccatctgctcctcatcctctctcctcatcttctttaataaggttgctctaagtgttgtagttgctgtatttcaggatatcaggaaggcgtttcgttgaatttctgatgttgctttcatggatgagcttggaaaatgtccaaaaaccagagtatttagatggattgatcattgaacaactcttcccaaaaggagtcaataacttgatcagtatccgtccaaaaggaggtgactggtgtgtcaccagggtactcccatctcagccctatacgatctgcactttgtcagtaacctgtggaggtgacagatgcttagcaaagccacagatgacgtgaaattacagagtatagatgctagaaatcgatggaaatctggagaagactgcagcaggctgggatgatggttaaaaataataagataaaatgtaatatcaattaatatacattcttacagttgggttccaagtgctagctatatatgttcaggtagggtgagattataaaggtgattataacaataacagtacaaaagcaatagctaatgttttttaagtgattgctctatgccagatattggcctgtgtgtttcatatcatcatcatgtgtataattttactctacactagttttatgtcatctgaaaattgtataagtacattatctatgattcaatgatatttaattcacaggatgaaagttgtcctcatttttcagttgacaccagcaagacacagagaggttaagtaacttgtacaaggtcacacagctgggaaatagaggttccatgcttgtgctcagtgcctgcatgctgaactaccgtgaaactttttctttttaaaatttagtcataaatttaatttgatatcctgccaaaacaccaaataagcttagagagttaggtagtttttaacgtgggctcggagccaggtcacctggattcaaatgtcagctcttccatttcctggctgagtgactttgggcaagtcgtttaacttccctgtgttctagttttctcctccataaatggggatcattcctgtcttacaggattgctgcagggattaaatgagttacatatgcaaagcatttagaatgactcctggcacatagcaatcacttgcttacaagtaagtgcattgctgttattaggctacacaaaaagcactatggtggggtgttaagagttgacactgtagagctagaccacctggatctctgtcatggcaccaccacttccatctctgtgtgctacagttttctcatctgtaaaaaaagaataataatcattgcagtgataagattcagtgtaaatgttcagtaattgctagctgttactatcaatagaagtatattgtccagagaaagaaaaatgctagtcctgttcctactgctgcgtttaggaattgaagccacatagatctctggaggaggcaggcaggttggtaagggtctacaaactgcagtggaggagttatctttggaccaattaaggacgtttcatctggaggcaaaatgactaagcaaggacgtgataactgtcctcactgtgttgagggttacaaaattggtgtgggtcattgaatcaagttatgagacaacatgggatgttgggaaaagtcaggggatcaggggcaggttgatcctgagtcagtctcttaacttccaggcttcagcttccatctttcacattttatgattctgtctccagcacgtagaacctagagcaaattcctgtttatacagaaagtttggataaggagtggttttgctgaatggctactgtagcagaaaagcttgaactgagtgttgctcaaatcaataaaatcacctgatgactaagccctgttttctattaaactgaaaagagaatgcaacagacttcactgggcttttgtgagaattacatgaggtaatatgtatgaaagcaccttatcaactctgaagtactaccccgatgcaagcagttatgttgattattgccatagctagattataacttttccaagaattagaatataatgaaacacacttaagcattaatctgtcttctgtgattcagaagatccttcaggaagttacaaaatctcagggtcatggccatgggcatggagtaattctgtagaaaaagatcctggctgtaaggtattctttggttttttggattcaaattaaataggagcatattgactacatgaaaccctgaagggaatagagatcacatactctaagcccgtcattgtacagatgaagtcactgagccacagagaagctgagtggcctgcccagaatcaaatgttaattcatggcagatctgggaataaaatccaggctcctgtctcccaacatgtttgtcatcattagtttaagaacatctcagaaagtctgaaacagggtcaaaatgtactgatgaatgtggctgcccattaaagcatggaattgaagaaatattagaagtaagtttaagggcctgggtgtgtcactgaaggatatgacacaatatactggacctactcgggagaggggagaagtacagtagaatttttagtaactttcttaatcacagcagttcactttctctgtacaaaattcttttcaaatattctctgaaactaattggcattaaaaatgctgatcttagtaaatggccctcaagaggcacgctatgcgcacagggaatagtataatataggtgcagagtaatggtctctctccttctctcctttttttccttttcctaatgatcattaacatctatattctttgactttgttgaattaaagttgcaagagatggccgtaaataaagcaagttatgtatgtgcctccctcattctgcccatgcagcttctgttccatttgcagctgtgagccgtgtaagactctcaagaccaagcacccatgagtgcctgggagcaagtagcctgtgaagggaggactttattcctggatgcattaaaagcagagtcccacctacacctccctcctcttcccatttataaatctacttctccagggatctacagattttttggctatatttttagtctgttgataatttgagaaagtctccaaggatctaagtcttggatgggtaggagtcaattcactcagtcttttttgaatccctaatggatgttcaaaaccagtctcaattctggatctggatgggacatgcatgtcgaagtacagtgtgatggataagagcacagattctggaaccagattgcctgggttcagatctccgcttctgtcattactagggttatgtgaccttgggcaagtcccttaaatgcgttgggcctcagtttcctaatctgaatccctatcatagggttgtgtgagcatgcagttgaatgagctaatatctattcatataaagtgcttagagcagtactaggtgcatagtagtgcttagtaaatgactattaagtaaattaaatcagcctgattagaattgcctccaggtgcaaggctctatcccatttagacacgctaacacacaaggtcttaagggctttaggtttaaggaaaaggggctttttcccccctcaattctacaccacaacctttttattctattgaattacaaaggaaataacagtgggacttgactttgaacaccaaagtttatccagcctctttccagctcggtgaacgtgtccacctacttcactctttatgctaaaggaagagcagcgacgctgataaatgtattgagtggcctcgagcaggtggcttgctctgtcaagatcacttttgtatgactgctgggatcaccacagtctcccctgtaacttgctgggttcctcttgtacataagccgagggcatttgcatcggttcctggtgagggggtttccacacggtggccctggttgcttcaggggctgggctgtgggagacattaatgggaagtgaaaagagaaactgttgtgcttaaccggcagagctgtttggagtgtgactcttcttgtatttagggaaaagattactcatgagtattttcttccatagaatataaagaacctcaaattactacttgcatcccccacccccttctcacccacctccctccgttgcagcgtgtcctctgcagaaacttcagcattttactctcaattcccctcccaagcaggattcagttctgtatttgctttggggcccatgtttccaataagccaccctgtactttttcctgtttctgcctgagcatcttctgctcactggacctctcacctccaggcaccttcctaggcctgaggaaccagaccttcacatgtgtcccctaatgggaactccctgtgtgaaggagaggaaggtccataataacaaatcgcagcgccattcttgttcaaaggtgacaccattgacagtaaggagttaggtttaaggtttttaccagttcaaaaactgagattttgctgagtaaccctcactgccactcccacctccctgtgattctagatacgtgttttcaaggtcattggagagagctggtacttcccatatccatggactgtttttaataggcatcactttctggccagtcaggagtcaaaaacaaaaacttttagtggctgtattttattctaaagatcataaagcagtaatgcaccataaattattatttgaaattctaatttgtttccatgtgaaaaaaaaattatcctaaaaacaccaagaaaaaagctcttaaatgctcatctctaatgatttccagtgcccagtagttctttttttggtgcactacaaaaaaggaattttggttttgaggggacttccacaggtttagaggaagccaactaccattcctcaaaactacactttgcaaaggagccacttggaagacaatcatgcccagaggccctggacattttccagggcatttgagccgtttgttccccacttcagcaggtaggaagagcagccccatatagcaaaccagattgttctttggcatgcctggtttaggatgaaaggtaattttttccaggatcaaactgagggacacttttataacacacttgtgaagtcttcgtagcaagtttaagtaacttatagtgagagacggaagctcctcttagcaacactgatgccattgctctgtttgagctattgattcacaccatgtgattttagagaatgaagatccattgaacatccagcttcttctgacccagcagttcttaaatttggtctcatgtctccttttgattcttaaaaattaatggagaccccaaagagcttttgcttatatgggttatagttatctgtagttaccatattattacataaattaaacctgggtatttacaaaatatttatgaatttagcaagtaaaatagccaactctatattaatgcaaacatattttaaaatatattttcccaaaccaaaaataatttgtgagaagagtagcattgttacacatttttgaaagtctcttaaaatctggcttaatggaagatggctggacgctcatctctgtttctgcattcaatctgttgcaagatcacatcatatgccttctagaacattccacctaagaaagaatgagagcgaaaaaggcaaataattaatattgttatgacaagatgttttacttcataggcaccctacaaaggtctcgggaaccctgatgggtcccaagatcacattttgagaaccactgttctaacttatcaaagatttctcacaacagcaaaataaaataaaactatagacttacagtcaggctcccagagagccaacctgagccaacctctcagcccctgctctgtacccccctcctgcccacttggttcctactcagagttcaagtaccaccccaccaggaagctctaatgtcagtgagtagaataaaaaggcagaagaccttttatccttactttgccctcttattgccagaggccagcctgatggtttcccagaggctgagtgaattgctcttcctggaagaagtttcagggaacatttcattatttggcagctctggaaggtcaagctcagctctggaacattctttcttcagaaggacgctgggctgcaatcagatcagctctgaatctgaggaccctccaaccacactgacacgtgtcatagttctgagcccctgtgggtgctgtgggcaccctggaacagcccctggaactgggcaaggaagggcaggtctctaagacctaccatcccttaaacacataaaagatctttttctcattttgcctctaaataaaaagttaatctgacagcacaccccagagtagggtttggtgtacaaactgctccctggactcctcttggaggctgcttctgggcttcgagaagcccccagtggggcggctcaaacaagggctggagaggggactcagagttgaacataagggctcttgagatgtggagactcattttgttaactattcagagaccttctccctttattccagctgtctaactgacaagacctttctctctttctttctgcctcatgctctctccaacaggcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgagagtctggactcttggcatatgcccaacttggaaagtctcttagttagtggttggtctttaacacccctcacccggcccaagaaatcccaacagtgagtcatcacaaggaagggatgacgatggaaggaagttgaaggaagattatgctagcatgagccagtttgagggaagaagaggaagtgtttacagaccaagggggagaattttaagtttaggagaggaacccagtttagtcctacgtacactggaacttaagggctctaactgtgccactaagaagaaaaagaaggctggccgtggtggctcactcctataatcccagcactttgggaggccaaggagggtgaattgcttgagcccaggagtttgagaccagcctgggcaatgtggcaaaacctcaactctacagaaattttaaaaattagctgagtgtggtggtgtacacctgtagtcccagctactcaagaggctgaggtgggaggattgcttgagccaaagaggtggaggctgcagtgagctgagattgcaccactgcactccagcccaggtgacagagcgagaacctgtctcagaaaaagaaaaaaatgccattttggccttttgactctctaaaagagatagctgagagtgaatgcaggctgtgaactgctcaaccgaaaacaaagagaggaaggagaaggacgtagaagggctagaaaagaaaatagaactgggggaactgcagataaagactgggaaatgggagatcctagtagccaaggccagtttagaaaggcttcaagtggtttcccttagaagtaggactcgtttgaggtaatgcatcttgtagcctgtagaaatcctaaaaaatacaagcagaggtctcctcgggctcatctgactcagaaagcttgtctaattaagggctcctgataatgcattagaagatttccattcagtaacaagcatctctacctgcagagtgtattgctcatgtggataaggcttcaaagatttgtctcagtttcatttcctaaaccctgtggatatttagaaggtacctgtctgggaactacatatgtcaaaggggaactgtggtctcaggtttatgcctcttgcgggattaattactgaagtactcaaggccctccttttactgaatcccactgcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaatagttcttttgaatttattacaaaatacttcccttttctattccagtggaaactcagagatattatactcaaagaggcaacgttatatatctggaggaaaaatccctacctctttgtgttccaatgaaaccattcatgtaaagcaagcaaaggaaaatacagtggtgggttttgacttgatttgacttggaccttgggcaagctttcctcccaagtctctataaatttccccttcatcctatctcaggtgcacttttttatagctggtttattttcctccacagtgacctcttagcattatttgtgaaactgggttctctctgctcagagctatgaacaaagatacgtgaaaatctgtccgcagttccttgccactttgtcgagtctttgtcaggtgggccatgtggaagatggtgctgctctcaaggaagttactgtccagttagaggcaggattgcgttgatctaaaaggccaaagaaggctggaggagggagagagcagagtagcactggtgtcgggagagaaggaatggagttggtttggaccatgaagaatgggtgggattgagtaggcagagggtaattggaacagcatcaccaagtatatttgggtgatggtgagaatgcccacctgatgagtagaagaggcagaaaaggcaggaagccctgataagcctgatgcactagaatggatgtgaggtgctatatagatcagttaggaggtggcaatagaaattcattccatgagtattcaccaagcaactctatgccagaggtacacaggtacaggctaagggagttcagagattagaggggccatttctagctggcttgtcgaacaaacctcatagacaaggtaatggagcctgactttgaaaactttgaaaggcaaacaagaaggagatgaggaagcatgttaagaaggagatgtaggccgggcgcggtggctcacgcctgtaatcccagcactttgggaggccgaggcgggcggatcacgaggtcaggagatcgagaccatcccggctaaaacggtgaaaccccgtctctcctaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaagaagaaggagatgtaggctggtgtacatggaagaggaattcagagacaagactgcacgtgctagacactccctttgaaacatggtcgaacatcactcaccatgcctctccggcttgtctgattgcctcctcacatttcaaactggtggactgtctcctggaaggcttctcttgactcccatccctacttccctaattccattccactttcctttctcccatcttgttctacctccatctaggctaggtgctgtttctcctttatcttagagcattctttccctctgtcatggcccttgacacagatacacacacacacacacacacacacacacacacagtgttatacattgtttgctgattgtttgctactccggatccctcccctagagtggaaagttcaatgtgggcagtgattgtgttctattaagtcgccaagtctccagtacctaacaccagggcatggcttccaggtggcactcaacaaatgtaggttgaatgatgacccggtttgagagtacccaggttaagaagtttgggttttattttacaggtaattggaaccactggaaagttttgatcagggaaatatgattggagctctctttttgcaacagacattttccaccagtgcgtagggtagattcattggcttacttaaagcaggaaagctagttagagtgtccttgctgtgatcctaatgggaggcagtgaagcccagactggatcagtgagatcaaaataatactcaggcacaaagtggctagctaagatggggagctgacttggaagtagtggttagagttcatttttaaagcaagcaatgccaggacattcaagaaaacttgtcctgatctgcagttggacatctaaaacaagaggcaggccagggctgggaataatagatgtgagcatcatacatcgtctccattatgtagaattttatgagctggggataaagataaatttatacggaaggtaatttaattaaggcacccactagaaagccatggacagaatttcaaggcgatgcctgccagcagggcctgtaggaaaacttaccacagaacacaggagtattgcgaatgggtttataagacaactaagttggagttgagaagacccatctgatgaaggggtcactcagcaagagggggaaggccacaggcatcctccttaggcaggggcaagatctagattgaaaatcctttttattttccagatgtaacatttgccactgtttcttctgacatgggctttctcctttagcagtttggtgtagtgaaagtcctcaggcctggcttctttctacacctggcccttcacaaatcacgtcacttcacttggccttattttcctcatccacaaaatgcagttctcaccacatggatcctaagctcccttccattcttaacagttcagcccaacttcaacactgaaacagtgttaagttgctagcaaacaatgtagctttctatgctctctatatatggaaacaacattctttaacacaactcctctccaatgtagagaggagagcactggactcaatgagttataattacctggaatacgattataccttaagtcaaatacagtagactccctgaatgccatattctttgaccagcttaacaaatttatcgcatctacttccaggacaagaatcctccattttcaacccctaggataaagcagggaacatttgcagtgtgctttaaataattatatggtctctaaccagaagatttcaaggttggagacaaatggaatattttctttggaatagtctcccagttggaggatataacagatgacaagtttataacatttgtaaagttaaagaataaatggaagggatcccaattttataaaacgtcacctggacagaataattttacaaagaccttgggctactagatagttatcacattaactggttctgaagtgatttaaattcagagaggtatttgagtacttgactactttgagactctgagaaaacacattgacaggagggaacagacaggttggcatttatattaacccttacttagggttatccattgcatgacattcaggtggaatggatttaggtacccattattttctccgaacaaggaaacccacaagttattatcaatttaattcatgttacactcacttgctatcaatgctaaaaaagggaaagaaacatatgttcagagttccttcaattcagcaaaactgtattggggatttgctaaatatattgaggattttagtagactaaaatctgcagtcttttcatatactagagtgtgattttgcaaattgtttcttccctttccaacccaccagaacctttgtctttggaaatatgctttgcttatatttttcaaatatagtaaaattttctttcaaagttaaactgaaaatactggtctttacatagtatttcttgaatcaaaattggcctattaatttctattaagcaatggtaggtttgccagattgaagggctgtgtcaactggctattttagaattaagtcagagcatccaaggatataggtcacagaagggaaattgtagccatgaaatgtgggagttgtagcaggcatgacccttgtctgaagacaccagagttggctctttctttactgtgtctttgagcaagccaaaaaaaaaaaaaaagtgtatcacacatcagagaaatgcttcgataggtcacttacgtgaaagtcattttatttcttttcttttttttttttagatggattctcgctctgtcgccaggctggagtgcagtgccgtgatctcggctcactgcaacctccgcctccagggttcaagcaattctcctgcctcagcctcctgagtagctgggactacaggcgtgcgccacaacacccagctaatttttgtattttagtagagatgaggtttcaccgtgttggccaggatgatctcaatctcttgacctcatgatctacccactttggcctcccaaagtgctaggattacaggcgtgagctactgcacccggccatcattttatttcttagctctttgcctgtcccatttgtgaaatggaggtgggcacccaccctgttgtcatatacttgaaaaatgcaagttttagcaatgttaaggttctactttaaacttactaaacttaagaagttaaaagttggagagacctaggtagccttgcagatgacgctaaacattggttatacaagttgatgtgatggtaacgtagggaaaaccaactgcacagtgcttcctttaaacacatacttatttcataaagttctgttttctcgagagcttattttgtttatctcaccttatagtccatatccagctgtaattgtcttactgtatctgttttctaacagatttattcttgtcttaaatatgatacttaaattttcccacaacctgttccttttttctcagggtctctgtgtataagacataaatattaaaccaaatttcaaatatttgttgctaagtaaaagactaatttatttttgtggtcacagaaggcactccagattaaattaaaaggttaattcaattggcctgcaaaaatgcactgaatggaatgcttagaaactaggaccaggctgggtgcagtggctcacacctgtaatcccagcacttaaggaggccaaggcgggcagatcacggggtcaggagatcaagaccatcctggctaatatggtgaaacctcatctctaccaaaaatgcaaaaaatcagccgggcgtggtggcacgcacctgtattcccagctactcaggaggctgaggcaggagaatcgcttgaacccaggaggcggaggttgcagtgagccgagatcacgccattgctctccagcctgggcaacagagtgagactccgtctcaaaaaaaaaaaaaagaaaaaagaaactaggaccaagcagagttagaaaaccaagcagtcccattacaggaatgggcatgttatgcactggtgttttcactgttgaatttattatgtaacttaagggaccgaagcttagggcttcatcctgaacccatcaaaggcagaaagggcccaacagagagaacattctgacatatctaaaaagtacctctcccacaccaggcatactcttactttaaaaaaaaaaaaatggccagagggaatctgaagcctctgaataaaaatcaaagagaagagagagctgtttgcaaattaaagaatgtgttacttagataatctacgtgtaaggatatgtacatagcaaatcatcacctgaaaaatgcagattttaacaatgttagggttctactttaaacctgctaaacttgagaagttaaaagttgcaaaaccccctgggagaggctctaggtagcattgcagatgatgcgaaacattgattccagccttctgagaacaagtagcgtataataagaacgtttaaactaatcatacactttcactgataattctattcctaagcaaatagccgaaggaaaccatccaagagtgggcaaaaaaaaaaagatgcccttaacaattctatttatagtagttaaaaactggaaattccccaaccacccccactgtgggactagctaaacaaacttggggagagtaaatatcatgggatacacggtagcctcacagccattcattcactcactcactgattattttttcagtagattttgcagggctctgcaggtcatgttcaggattttacatgtttgtttgaagacaagtagaagccatttgttttttgttgtttgtttgtttttgtttgttttgttttgttttgagatggagtctcgctctgtcgcccaggctggagtgcagtggcacgatcttggctcactgcaaggtccaccttccgggttcacgccattctcctgcctcagcctcccgagtagctgggactacaggcagaggatcggcatggcaaggtgcggcggtgaaaagtggaggcggggcatctgttgggctgcagtctacgagcaatagttgtgacattaactaaggtgaggcccactgagagacgaggtggttccagaaacagataaaaggcagagtctgcaggtcttggtgaccactttcatgtgagatgagaaggaagagaggccttaacgattactcccaggtttctggtctgatcatctgagcatttgctgacctaagaaacaccatctcatctgtagagatgtttgtgttaggcacatcaaatgtgtggtgcctatatgacctccaggaggaattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtgggagtgggaaccagaatggaaggtgaggaagtggtgagaatggtgttggacagctcccctgggaagtttggctataaagggaggagagaaacaggagcagttcctaacagggaggatggggacaaggggcatgtacatgtggacaggaaaaaaacttgaaactgcttaaaagctaaagggaagaaacccaatagaagaagttggcaatacgactgcaaatggggacagtaagagctaactgtaaactggaaatgtctgtatgaaatgatgtcaactggggaaaaaaattccatccatatgaatgtgactttgtaaaacttacgcatgtgctttaaatacaaaagtactgaaacaaagaacattttttgccagattttgtgagacatgtctgttcacgcttatgacaattgcaagagacaccatccattgagcgtttatgatggcagacgtggggctggtgctctgcacgtatcatctcatttaatccttataacagccctgccaagtctgtggcatagttctcattttacacacaaaaatattgaactaagccctgaactatggctcggagaagaaaaatagcttccctaagggcatacagctgacaaagagaggaacaagattcaaacttgggactcccttgctccagagcccaaattctttcctctaaaattaagtaacttaaataaatttaacccccctcaacagcatcttgcatgttcttggtcctcagacattagtaagattgatcagccaagtcacagcagtattgttcactcgctctctcctgtccatttggaacacattacaatacaataatggaatttaggattctcaaagaacgtgcctggcttttcatgtaaagatcaccaatgcaaaactgtgttttgtttctgtgtgtgcgtgtgtgtgcgcacgcgcgtgtgcatgcacccaggagtatatctagattttatgggcctgaggcttacggtttgggcaatatgaatctttctagaactcttcccagggacctgcgcaagtgaagggccccgaagctcactagcttcatggtacatcagcctctgcacatgcgtgtgtttacatgaactgtgtatgtatgcgtgaagatagatggaggaaccaacgaaaaccatggttctttgaccagtagggctcagttccattgaatagtacaatagaaatactagttagtaccagtcactgtgtttcttttctgggaagagagagaagatttattaaaaatcaaatgggttaagaattttctgaaaaatgccctttgaatttcagccattagctaagttagatatacagtgctgtggcgcatgctctttattttcagtaggcaaataaatataacatttttaaatatattctttatcccagagactgttttggcgttgtttgtttgtttgtttgtttgaaacaaggtctcactctcatgcaggctggagtgcagtgatgtgatcacagctcactgcagcctcgacctcctgggctcaagcaatcctcccagctcagcctcccgagtagccgggacaatgggcacgcatcaccacgcccaactaatttttgttttttttgtagagatggggatctcactatattacccaggctggtctcaaactcctgggctcaagtgatcctcctgcctctgcctcccaaagtgctgggattataggtgtgacgcacagcacctagccagattcttttgttagtaacaccttttagatgtgatctcctccatatatgaaaattggaagaatacatcaagagagcaggctgggtgtcgaggaatgaagggacactggaaatgaaagaagatggagggctgtcttcatttacttagcaacctgctatagacaagacacatattctgtgttacttcacaagccaaaactaagaaccaaagtacagggattgcaggggaagccagattccacctcagcagagaaactttctatcaactagagctgtccaaaaatggtttgcttgcgccgtgactggctacccatcactggaagtacccagccaaagccacttctttctgggagaaggggaggtgggagactcttagtgagcaaagtttgagtcaatctaggaaacctctagaatcctgtctagatctaatattccaagttattactgggacacactatcgctgccaatcatatgctcacagtgcacgcacagcaagtggtccccgtccgcatggtggtgatgtgtttttgctgagccagccgcattccctgacggagcccctagttgctgaggaaacatgtctgtgcatggactgactcagctaaggccacactcctgggtcttagaactaagttttttcgtgacccagtacccaggacctcgggtccatgttcccacccgtagccgcctcatggatagcatttaagataactcccaataccttattagtctcctaataggcttctggtctaggtaggaaactggccgagtccacttgacccgcccctccccctgcttcctcctgcacactcgggaagaacccctctgaccctgctcccttggccagcgtcagtatgggaggctgaagcaagcccatgcagaagcctgggaggtgtgcggcagaccacgtgtcagacccccagaggcttagcccaccaggtcaggatgagacgtccagagaacccaagactaggagagtggcctcagttaaccttctttaccctttctggaaggggaacgtaaagctggccgtgacccagatattcctctattctccatgtgagacctccttagagatctacacacctgtcccaagccactataataatatcaggaatagtaatgatgggagtgtttgtggtggtggtggtagtggtggtggtagtaaaatcaatgactagtgtttactgagcttttcctgtttgcctcacgccatgatgagcttgttacatagaccatcttattgaatcgttacaacgatctcacaaggtagatgccatcaacactgccattttatagatgaggaaactgaggccaagtgacattaaagggcatgcccgaggaggcaccagtctgactccagagcatggcctcttcaccatgctgctgtctttcctcagtttctctctcatgaaaacacagaaggaaaagtcacctgcctgctctccagcccttgtttgagccaccccaccgggggcttctccaagcccagaagcagccaccaagaggggtccagggagcagtgtgtgcaccaaaccctactctgggtgcttcttgacctttccctcctttaaccctcatagcaaatgctggaggtcggtgttattatttgcattttacagagaagttcagggacttgttcaaggtcacctggtgcacaggagttgggactcccaccgaggcagccgtgcccacctctgcagtcagcacctcccaccaccacaccagcccgcctggttaagtgaaccaagctgaacaccctcacagacactaaatttatatttcctggcctccccttccaaaatggatacactaattactggacctttttttttttagtaatagtaatcatcaggaacacatttttcaatgttttcatttttctattccgcatactaccaaaaaaaccagataaaacccagcaagtgtgaggccctgtaaattagcaaaagttcaggaagtcattacacgaaaccaaaagaaacaaagtgttgattaggggcttatttttgtatgagattaaaatatgaatcattaaaataggactgtatttcaggcttcttatccccgcctcatcagagacatcaccatgactactaggtttggattcaatgaattccgaagccgttctcagctctcaaatgcagtcatgtgtgccatggttctgccttatacatagcagtttcaaaagtctggtccaggacacctctgcatcttcctgcccatctccttttaataaaatgcccaagtgacatggtgtctgcagctctttgaggtattttgctttatttagtcatgatactaagtagtggcagaaagttatactaacagcaaccaaatttcaaaggtagaggtaggaacaaagtcaaggcaaaaacacaaggttccctcaggaatcccttagaatagggtatccgtggagttttatttagtgtcagtgatagaggagcaggagtttgtagaaaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacctgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggttaaaaaggcatatttttctctgtagggaaaatttctgtgaagaatctatgagttgtcattggagcattacaaatgttcttaatgacttcataattcttcgagtaatctgaagtgcaagctaagatagatgtaaaaagaacatcctcacaaaaaataagagcaataaattgggatagtttaaattccctgccattgttcggcagctactgaagcagttcagtaatgtgggaaaatgttcaaaacctaatgtggagggaaaagaggatactcaactattaaaagcccgcttctaactatagaactatagatagtattaacagggcttctgtatcttagtgatgatgggattctaggtcatgttttgttttctttctgattttctgcctttttaaaacatttttggggccgtgcacggtagcttacacctgtaatcccagcactttgggaggcctaggcgagtggatcacttgagctcaggagtttgagaccaacctgaacagcatggtgaaaccctgtctctactgaaaatacaaaaatcagctgggtgtgttggttcgcacctgtagtcccagctacttggagggctgaggtgggaggatcacttgagcctgggaggtggaggttgtagtgagccgagatcgtgcctctgcacttcagcactggcaacggagcgcaaccctgtctcagaaaaaaagtatacgattttcataatcaaaaaagtttgatttacaacttcacatcgctctgaccttttgagtttcaagtgctgcattctgtgccccatgagcttggtgagggtaggaggtggcaggtgcgctccaattgtatctttggcaccgtgccaggcacttagctgctgctccgtagatcgttgttggaaaaacatctttccatttctcgatttccctttcctttttctttccaggtgatgtgctctatgaactccttcagcatattctgaagcagaggaaacctcggattcttttttcaccattcttccaccctggaaactctatacacacacagccggaggtcatactgcatcagaaccatgaagaaggtactggaagaggtttctcttttcttgcctgaggtttagacaaatccaggaagtttaattgttaacttgataagctggtcttcttcgtgtaagttcacttttcattcagtagacaattattgagtgcttactatgtacaaaatacactcttggttccctgaagctcacgatcaaagcgaagcagtgagatggatgtacacagaagcacagaagcgtaaccatatagtaggcaccgtaaaggtgtggtggaagggtccatgacagccaggtgcaggaagcagggtcttctcataaaggaagcaactctggagtatgccttagagcagtgctccccaccctttttggcaccagggaccagttttgtggaagacagtttttccaccaacagtggaggtgagggatggtttgggatgattcaagtgcattacatttattctgcacttcatttctattattacattatcatacataatgaaataattatacaatccaccataatgtcgaatcagtgggagccctgagcttgttttcctgcaactagacgttcccatctgggggtgatgggagacagtgacagatcatcagccattagattcccgtaaggagtgtgcaactagatcccgcgcatgcacagttcatgatagcgtttgtgcttctatgagaatctaatgccgctgctgatctgacaggacgtgggactcaggcggtaatacgagcagtggggagcagctctagatacagatgaagcttcactcacttgcccccaccgctcacctcctgctgtgcagcccagttcctaacaggccatggactggtaccagtcagtgacctggaggttggggaccccgccttagaaatccagcaggattctgataagcaaggatgaagtgaagaacattccaggcaaagaaaatgacgtaagggtggggtaaggctttgaaatagagagcaattagatgacttggattataaagcttatcttctcccactcttttattacagaaaatttcaaacatactccaaatagaataaaataaataaacccttctgagccatcacccttgccttcacaatgatcagcattttgtcattgcagagctagtccaaggagcttagcttggaaccagagtgtggagaactttgatttctggaatatggaggaaagaaatgggaagtcattggagagttttttagcaaggggtaataaaagttggaagaaggaaagaaaaaaaaacccaaatctatgaactcagtgttgggccagggctttctgcatagggcaccaaaggaggctggttagagttcactcagtggcggtgtttatttcaagtgtcccagttgttcctcttaatcattggtagaaagcaaaagaccagaatttaatttaggccctggacctagttccagaataggtgttggggcacagaaatagagtataaaaaccttacttgaggccaggcgcggtggctcacgcctgtaatcccagcactttgagaggccgaggcgggcggatcacgaggtcaggagatcaagaccgtcctggctaacatggtgaaaccccgtctctactaaaaatacaaaaaaaaaaaaaaaaattagccgggcatggtggcaggcgcctgtagtcccagctacttgggaggctgaggcaagataatggagtgaacccgggaggtggagattgcagtgagctgagattgcgccactgcactccagcctgggcgacagagcgagactctgtctcaaaaacaccaaaccaaagcgaaaggaaaccttacttgagcaccattgcattaaacagttgaacagcttgagcactcagtgatggatcgtgcctctgagggtcatgatcctcctgctcggattggtcagaccacagacgtccaaacgtgcatcagtttcttcatgtgtacttttccttaggtgcagattactagggacctcaaaccctggtcccttggggcatttccttaaaatgattgctcatccccaagagcagggctaacaattttgttttgttgttggcaaaccaaaaaatgagaagtttcttgtttttcctaattaacacttcacaaaagagagcctgactccaggcgatgacaccacctccttgtgccaagcatttcacagcagggcccctcgcttccgtgatggagaacgaacagcatttcgtgcacgctccctgccttcctctcatcctttcctcccctcactctacccttgctaaatttagcagctgccctcctcccccaattcagttattcattcttttgctcttcctgccatgtgcatttccggcttgcataatagccaccagccactccagagaagaggaggtgggtttactgaagcttgacattaaggcaaggaatatattacctagcctgcctttcagatacaaagggtatgtgatgggttttctttctgtctcttagtctttctctcattattttttttgttaatctcatttggaatttagccccattttattcctgagtgtgattggaggcttatggtctctcctcctcacagatccttcctcttttccctttggcctgatttgactcagcagtaggtgtgtttgttgttctcatttgcaggagctcagcaatagagaaagctggcttactctgagagctgctcgcaaaccaagtaaatacagatgtgccaccgcatacgctgtaatgagctttctctcaagtattatgatgttggtggttgtgagctcagtaggtaagaggatggagctaatgaggccgaggtcaagggtgtcattgccctgcagaccagttagctctgcttcagacccagctcttaaaagtagtgcattttcagagaccattccttaaagctcatggccaggaagcaaggtctgagagcatgtccgggcgcatgtgctccagtgaacaggtgcacacaacaaggagagaagtgtaggtctttatccggtggtatccagggagaagagctttccaaggcacagaagtgatatgaagaggtggccctctccctatcctcctgcctttcagctatatggtgcccttgatgacaaagagaacaagtagagaggtgcatggatcagtacaagtttcctgcctccagctacttcctctctctctcccttcttctccactgaaaagaaaaaaatccagctcaacataaattgtttccagaatcaatactgttccatttaattatgaaggataacagatgattgatgtgggcatatgttaacatacagaaagatctggttctgaaaaaaaaatctgtcaagtgaaattatacatatcaaatattacttccccagtgatttattttacataactgggaatacagttccatataaaagtatgttaacccaagatgacacatgttgctgccaacttggcataggtaagtaggtaggtgggtaggtaagtaggtggataggtggataggaatgacagaatggaaagagaacaaggcccaactcagctgttaagcagcctggcacaatgaagcatgcacggtcaagtgcaaacagaaggcatcattcaaccgccttgtgatttcacctcgtcgtggccacaaacttaaccagttcagacattcataatttcacaatgggcatttatatcacagtacaaatgtgtcttgctcaatctagcaccagttccccacatgtatcctctatgactttcttacattgaaacttacattgaaatcatgccttcgttagtagccacgtggcagtgctagaagctaggaagttggtgttagctcagaggttcacctccatgccctgacagtagacgaggatgatcatcatgctaattcaaactctctatatgtgaacatttgttacctctataatgtactccattctgaaatcacatcatggcttgagcaaagcagtcctcagattacacttacctctagaaaaaccagcattttcactctttttccttacttattagttatgggaagggagggtgattttatataattaggttaaccttataatttttcacccataccaacacacttatgacagtgacacagggctccagcaataagtaagccaggactacatatcaaatattcaggcaaaaccagaaccagaaccatcctcgacaaacaaactggggtgagtgtgtgtgagtatgtatgtatattttaaaggatgagatctggaaaccgggaaaccaggtcctaacccttcattctgccagaacagatcataagggctaagtttctcattcctctggctctgtctccccagttataagaagggggttaggctaaatggtttctgcagtctcttacagctctcaaatccccacattacgtccaaggaacctgagtcttcctgggtgatatgaagataagacatattcccttccctcagggtcttgagcatctaaaatctagaaaatcatagcagtgtcctgcctggtgttgctcagaagcgggagaaaatctcttctttcctcatttgtctcaccttattcagaacttcagataatgttgcccctctgagagtggcagcaagagtagcgtcattcacttatttcatcataaaaagctcagtttaaggacattctttttccttgactgttgtgactcattttatctttgtaatatgaattagaatgcaggtaggtagttatgtagaaaggaggtaaaataaacaatgatattacttccttcacaaaaaccaggaggcaaagcatctttagaaatatcaaagcagtaaatgactataaaataaatttattttgtcacgtgcagttgtgatgataacttcttttcacaccttaggttcttttattttgggttttatccccttaaatatatatatatatttttttttaattgtcatttgtcctctagtgttagaactactggaatattggccccccaaaaactcaacggaaacataaaataagcctcccttctgggctaaagtctctgaatgagaccagctccacagaatcaccccatgggactggatatgcagtctgtagggagaaggagcaagatccggatttctcaaacgttctcatcccatcacccccttggagcttgataatttcagctctttagttgcatcctgtcctctgccccatcaaagagattatggggcagtgattcttaatcactttaatttgcagatattcacacatgcagggctgagattgtttctgtagcactggatgcagttttaaggtggcagttctgctctgggacagctctttatcacaaggtaaacatggaaatcgcaagtgatgaggagaactttcaagcatcgaagtgcaattgatctcaatttttcttacaactagcacatgggaatggctcaataattgagagaagtcatttctttgtgaaagatggagagggtggcatgtgttctgcgatggcccacagaagttttatttatatgattgctttattgaggggaatcgtacccctcctgccccaccaccaaacccaagtgcccaaagactgctttggcagaaggaagttgtatacaattttaatgagataattaaagaagatgaggtatatgaatctggttttttttttttttttttttttttttttttttttttttttgagaaggagtcttgctctgtcgcccaggctggagtgcagtggtgcgatctcggttcactgcaagctccacctcctgggttcactccattctcctgcctcagcctcccaagtagcagggactacaggcatccgccaccatgcccggctaattttttgtatttttagtagagacagggtttcgccgtgttagccaggatggtctcgatctcctgacctcgtgatccgcccgcctcggcctcccaaagtgctgggattacaagcatgagccaccacacccggcctgaatctgcttcttaataacaaaataatagctaacatttattgggtccttgttgtgtgccggccctgttctaagctcttatatctttgaatcatttaatcctcaccacaaccctataaagaaggtgatattattacctccactttatagatgaagaaataaagattaagagcaataaagtaacatgccccaaaatcaagtagcaacgctgagatttaaacccaggtggggttgatgccagtgcctgcattcattccactgcgcagaatgaggagaccaaaatacattttcataaatatttgtagtgtaggcgccctgaaaatagagcacatgattgaaagacgagtagcagtagtggagatgagaacgccaaagcagttttcaggtcagctgactggggctacagtgtgtggcaggtcctgcttacattactgccaaatttgtactaaacaatgtcaaagatgacttctgggactccaaagtatgtctagttcataatattaaaaactcatgctgagttggaccgaattcacccttctagatcattaactcccttgggatgggccgtcttagcatcacgaaaatctcccagcctgtgagaactgtgggttctgagccaggcaccggcttctgagagcagacacactggctgtcacctaccccctgaggagccagcccctcagtgcaggtcacgccttgaaagctggcccctctctacagcggcttagtaggtaacaggtagacgcattctttagctgctcaagtcacatcctgtcactggttgtaaacccactcgattctctagtcttgctggaatcgtgttgatgactgcagggtcaaggaggctgtgggctggggtttgacatctttgttacacatattaaccacggaatacatgacagagccagagagcatgccggcacgtatatgcgtgcactctacatcccccgactacctgggttctaatcccagctccccagtttaccggctgtgtgacttcaggcaactgccttgggtctcaggtctctacctgtaaaagaaggaaaatgacaggacctatctcaaagggttgacataagaaagaaatgagtctccagcctgggcgacagagtgagactctgtctcaaaaaaaaaaacaaaacaaaagaagaaagaaatgagttaatacggaaaatgcccttagaatagccaagcattcggtaaatgttattcattatcatgattcaatatttctggctgttatttggttgtttccccccctctgtttgtgtaaatttttaattgggataaaatacacaacatttacaattttaaccatttttaggtgtacttcagtagtggtaagtctattcacaatgttgtgcagttggtttttccttccacttttcttaaccattctcaatatcgcaactacatccactttgtgcaaacatcaggtttgtgcaccttatacgtagggaagggccattgcctccctcactgttatccaagaacacctttgaggattcatctgcactatgatttctgtgggaaaatacatttaaagtgccagtcttcattactctcagaacacggcctgtttggaagtaagcactgcttgcattttatgtccccttgcagtatctggcgagcgctgggtcctccatgacccctttggaacctttgtattaatcttctggctgtctcctttaagaactacaagattaacctttttgcagccctttctgttctgggattcttgaatctggcagcaggtaacgacaggtcccatcagaaacaggtcaagatcttgacttcctgccctccctgggagcagggcccacgagcaccacttaacacctttttcccctgacccagcctcattccagccttctgcaagtcctgctttcctctccaggacctttgttcctgctttgcttcctatatttcagggcctagggcagcatgaccttttaccttctgacccttgcccctgctgcagcatgtgttttgtgacggagtgtagggactggattgtgcagagaccctctttgcatctgtctgggccctcggcctattacaggagggacccctcacccttcctgcctgcaccagggtcctccaactggaggctgcttttagccctagggctagcgtgctctcttaagccagaagttttaggggcaagagatccctaatatgcatgaatgactctcacaagacaggcaggaagtctccaagagacttcctttacccctagggaaatgccatctgatctttgagataaggggctgggagcagtttgatttcatctccagagaaggaagccctcagttaaggggtcatcttgctcttttccccactccagggcctctctgccttatctctgtgccacctgtgaccccaggccttatacatgattgagaggattacccaaacagacctaattgacttattggaaatccaatcctttgattttttaattcacttcttttgtgctgctttatggagacaaaggagactcccctatactgcctgtgaagagcaagacagtctgcagccccgactgtgaggactgtgaggcctcctgtgtcagcagatgtgcatgtactctctgtactgatcccctggaaaggtggcctgtttgaaagcagtcctgcccaggcctgcagtaatgaagattaagcctcagagtactacaggttacccattttgttttgtttagcccctttcatcaaatgcttataaaattctaggagcttacctagggtttattgttgataacctcaaacatatgtgaatcatccactccaaactagggcagttttcttctcaggccctccaagggagttcggtgacattggcacattgtggggatgaataggctgaaatgccaggtacacagttagtggaaagactccaaaccaagcaaaggttgaacgtcaggtaactggagtagggggtgtattagttagctagggccgctgtaacaaagtaccccaaacggggtggcttaaacaacagatatttattatctcacttttctgggggctagaagtccaaggtcaacgtgtgccagagttggttccttctgagagagctgtgaggtaggatctgttccatgactctcttctcgtttctggtggtttgctggcaagctttggcattccttgccttggaggtctctgccttcatcttcacctgcattcttcccctgtgtatgtctggaagtccagagtatactttttataaagacaccagtcatattggatgtttaaaatgacctcatcctaactaattacatctgcaaggaccgtctttccaaataagatcacatcctgagggtactaggggttaggacttcaacttatgaattttgggggagagatagtcaacccataatgggcataagagaccgggagtggtatatgaaatatagtttgaattccacctcaagaccttgagcttatgacttctgtctagctctgtgtatcattcatacttcccactaatttttaacaaaatgactgggagagggagaaagtgaaacccagtggactgaggcttgagtgagcattacctcctgggcctgttgatttgcgtctccctggtgaccttcttctctgaccagcatccgtgggcttagggaaagcacggtggtggaaatgtgatcctggtgtgtgagatgcaaacttgatcttagcctttgctctccctggaaacttatcggtcaaaactttcactaaaggcagttttttgtctgtttgtttaggtttactggttatttattatttatagcatggttaaattgggtcaaatttttatgaattgtaagtagagaaacttttctaataagaggaaaggataagaaatcagacctttttgtaaagaaaattaccccacttaaagtcctggtttattttaggccgtttggcagtgagaagaagggattatttgtgtctgacagaggtctacaaggaaaaaggtttgggatcagaaaacacttccaaccagaatgacggttccctgccagtccttggtctttcttcctcccttccttctgtgcccacatggactaattatgtctggctttccctccctcttccttgtatatttcccttccatatcaagaccttcagaatgagggcaatgtggataatttcccagttttccagctgggcagctcaccaagaacaaacccagacatcaaggccagaccaaaaaaatcttcttgttttagacagaagactcctacatctgggggatttaatgcacccactgtccgctcagtgcatttcctgtgtccggagcttctctgcctgccggctctggtctcgtaagtttccatgccctgctgccaacttataataacagaggcggcaggcagcaggctgagaatgtcatagcctactccatacatgggcactgctttgcagactgaaacaaagcttgcagggtctcattgcaggcctctcagccttgacagtggttgtgcccagaccaccaggagcctggaattaaataccctcggatccagttctctactgttaatgttatcagcttcatcaagtacttcctctttgagtgatatctgtggagaaataaataaatcaagctcctccaagtcctgttcctgcctggatcctgagtccaaagtaaaatctgagttggattatccaaagcactatcaccctcctgcattgttcccaaggtctgggcaggaacggagagtgaaatctctccaggacattacatcagttcctcctttacccttggcatgaaagttcttcctctcctggtcctcccagacttcctaaggcctgccctgagtgcacacccacacactaagccttgaagcccaggacatcaaagaaagcctgcaggtaaccagattactgaccaacgcctgtgaccgttttgaaatttataagatgggaaatggattcaggaaatgggatttttcaatacatggtcttcatcatccttaagtatttttaagccttaataagcttttaagtaaagagagacattctgtaaatggcatttagaagaaaatataggaaagttcaaactggaactgtcttcaatagttgtttacagtgatcatattctgtgacaaatgaaaagtggaccagggacaaaagataaatacatttctatgggcagcagaattgacatccatattatctataaaaggaaagtttgccttgtctacaaaagattacagatcattttagttggtgcccagtaagcatttctatgcatttgggttaaagtgaggaagttagtgcttgtctttccaacctatatccttgcaaggttaattaagcactttaaaaaaaaaaaagctttttataacaggaaatatcaaacctatacaaaagtaaagagaattgtgtaatgaatcaccatgtacccatcaccagttttgatgatcaactcaaggccaatcatgtcttcctctgtggtctacctcctctctccttcaccatcccagattattttacagcaaatctcagatatataatttcccttgtaaatagtatcaacaggctgggcgcggtggctcatgcctgtaatcccagcactttgggaggctgaggtgggcggatcatgaggtcaggagatcgagaccatcctggctaacatggtgaaaccctgtctttactaaaactacaaaaaattagccaggcatggtggcgggcacctgtagtcccagctactcaggaggctgaggcaggagaatggcgtgaacccgggaggtggagcttgcagtgagcagagatcacgccactgcactccagcctgggtgaaagagcgagactccgtctcaaaaaaaaaaaaaaaaaaatagtgtcaacataggtctcaaaaaaagactataaaatcataatagaaccatcatatcacttgaaaactagtagttcctcggtatcatcaaataatctgctagtgttcactttttgccaaccatctcataaatgttttttacagtttggatcagaatccaaacaacatctatacattgcagatggttaacgtatctcttaagtttttttcaacctataggttcccatctgcaaccttcttgtgtgtgtgtttgagcagtccctctcttcaggtttttttaaagaagtcagccataattagtatattcgtatatataatatattatatatattagcgtaggcttatatatactatgtaagtatatacttatatagtattagtatatactatatatcatatatactataatcatatatagtatatatggtgtgtgtgtatatatatactatatatcatactatgcatatatagtatattagtataatctccccctgtacatagtttctttttttcctctggttgctttcaagattttctctttatttttggttttcagcagtttgactatggtgtacctgggtgtggtttttattttacatatcttacttgagattcttggaccttcgaatttactgttgttgataatgttgttaccaaatttgaggacaatctagccattattttttaatttattctactctgtttttttctatattctccttcttggacaccaattacatgtgtgttagaccacgtgatattgttccacaggtcactgaggatttgttttgtttggatttcatttttactgatctgtcttcaaattttctaaccctttcttctctcatctccgttctgctattaagtccatctagtccggtctttcatttcagatattatacttttcagttatagaatctttattttgcctttttttttaattccatttcccttttggcagcctgtatgtgtcatcatttattacaaccatgattttcttttagggcttgaacttatttataatagctgctgtaaagtttttctgtttgtttgtgttaactccaacatctgcattatctcaggttctgtttcttttgatggcctttcctccttattatgagtcacatgtttgtatttcttctcatatctagaaaattgtgactggatgctgagcacattgagacactggattgtgttctattccactgaagagtattgacttttgttctaggaggcaatcaaattactggccagttactttgaatctgtagaggcatggtcttacgtttcattaggtccaatctgtttctattttgccttttgcccttagcagatccccttgtcctagggtttttactcctacattgtggccattctggggtaacaaacagcctgaagtgtttacagagcctttgaacttgatgagactcaaactctgaactctgtctccactgcagtagccagtagctgaggtttccgcttagatcttttgattatacaactgttgcttttcactgaactccaaagggtctccctggcacttgggctattcggtaatcagacaagaatttgaggaagcttttacatgccaatttaatcactctcccctctgtggctcccactgtatgggatttgtttcttcaattttctgccattctggcagctacctactctatctcaagcaactttctgtttatcttctaactgcccctgtgctgcacggactggggaggaacatgcagcatagggcagttaggagatcaacagaatcagggggaaagctgtttaaatatggacctcactctgtgcagttcccttctttcaagagtgaaatcctctccggtttttgtctgcccttgataccttcaaatagttttttcaatgtatttaatatggtttctttcatttctacccgtaagaaggttagtttggtacacgccactctgctattgttgaactgaaattgcccctttccttgtttagataagtggtggcagatcataaatacttcatcttgcttttcgtatctaaccatagattctgatgctagtccttagcaaaatatcaagatactcctcattcctttttacttttacgtagtactccattttttagagatatatactataatttattaaatcagtcttctattgatagctattccaatgatgaggcacttgaatttatggcagtgggttatacagtagtcacaaaataagccctttgccttcaaggagatgatcttttaatattgtgaacaatatttttgttcagtgatcatatgatagatgagatctagtagaactttcaaaaaagaaaaaagtccgcattttcttcttaaccctgtgtaaaacttaaaaccactatgtctgtctctgtttactgaccctatcaaattacggaattcactttatgtgttcttcatatatgtatattatcttaatggacaaaggtgatatgtttgacttgctttacttagaactgtggacaattctttgaccagaacaaggacagcaagcatgcacatccttttggtgagactgccctgggaacagatgtggccagagagagttcattgagttgggtgtggagccgtgtagaaatccccatttttatgggcagatttctgtccttctgcaccttagcagggacttctggagccaggtgtgtgccggtccattccccgacccagccctcagagctacttctcttgctgagctgtgtacacttctgatgttatcctcgctcacatgtcaccagcttgcaactttgagtgggatgagttagaggtgtccatccatcctgcttcttccttacttctgcctgtctctgagcactcaggagcaaagtgctcccaaaagttctttcaagttcagtaagattgtcattctgtaaattggggccactgtgcatgcttagagcaggttttggtgtgactttgtgtcatagtttctatattgcagtgacagatgttgtcatgagtacacaggttctagaatctgactggagtctggttctataatctcctaactggctgtgtgaccttgggtaagttatttaacttctttacgcctcagttttatcatctgtaaaataggggtactagtggtatctcttggttaggagtgtcatgagtgtcataaggttgggggtttttttcttttttcttctttttttttttttttttgagacaaagttttgctctgtcacccaggctggagtgcaatggtgtgatcttggctcgctgcaacctccacctcctgggttcaagcgattctcatgtctcagcctcccgagtaactgggattacaggcgggagccaccgcacccagccaggagtgctataagttttaaacagtgaaatccagcatctaagatatagttattactaataattattactaatattattaacattatcactaatactaataactcctagagttagagaatatgaaaattttagttgtgaaaatgtaagtcaatgaaagcatctagagagaaacctgtaagaacccttccacctctgaaagcgacgtagaagagttaaatgatggccaaaagatggggcatggaagtttggcttccttgtgcctacaggccacaggtaggtcattaacggaatgcttgtagacatccttaggttgtctggcaatagaaaaatagtttcaatatgcacaccttaaggccaggcgcggtggctcacgcctgtaatcccagcactttgggaggctgaggcaggcagagcacgaggtcaggagacccagaccatcctggctaacacggtgaaaccccatctctactaaaaataaaaaaaattagccgagcatggtggtgggcgcctgtagtcccagctactcgggaggctgaggccggagaatggcatgaacccgggaggcagagcttgcagtgagccgagatcgtgccactgcactccagcctgggcaacagagtgagactccatctcaaacagaaaaaaaaaaaaaatatgcacccttcaaattgttaagcagtgaaaaagacactgcattctggggagaaaggtcctttacacatacctacacgctcctccatttaccgcctgtagagccgcagggagtttcctgtcctgccaactcactggggtctgtgattgtctttccctctgctccacagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcaggtgagtgagttcccctctcgccgctccagcatcatggggacctgacaaagtcccactctcccctgtgatctttgcagccagcctcgcaccattcccaattaggcgccctccaaggctctctgagggcaattggaggcttctgcttggatgaggctaaatccctaatggcttggttaatgagccgctgggatggagtagttaatgagcctcagaaatgttaagaaacaaatgtcctacgtccagcttacaaggagagtcacatcagaatcaaggctaagcgaaaacatttaaaataaaaggtttatgagcatgctaatggccctgtcctgaagtttccagcagctaattaatgaccagacacagcataaagaagctttgtctcagattcaggcctgtaattccatcctgtgagcggtaacgccatgcagccttcaccttaggagcgggtaggagaggaaaacaggattatggtattggaggcaggtgttgctgggccatttggacagaggaaaccactcccagattctctttcatttattataagaagcccaaatttgcttacttaagggaagaaaccagtggaaaccagtgggaaaaatatctacacattgtctgtttcctaggatgctcataatttacatgaactcattcttcagaagcttaatcctctaaccatgtgacaaggttagctcttttcgtagagcatttctccattagatatttgttgagcacctgctgtgtacaaataaatgcattaggagtagggatacagagctagtttaacatgcaatatctttttccccaaggaatttagaatatagtgggagagacaaaggtgaaaaccactaagatataaggcagaatgaagtcagccccatttcccattcattttatgtaccagcattcattgagcacctactgtctgccagagtaataaagcgctgtagaagcaaagcagaaggaaggtgtgttttgactggagggaccaagcaaggctttgcaggggagagagcctgatactgaagtgactgtgctttcgatagtgggaaggaggcctggaggcaggagagaacggacctgttcagggaagggtgagaaatgccccctcctccctgagcccatgacccggtgagagctctagctgaccatcaaggtgctgccatgctgatggcagtggaagaacaggctcctacaagcctactttacttctgccttgaggtactgtcccttttttttttttttttttccacactctgttgcccaggctggagtgcagtgacggaatctcggctcactgcaagctccgcctcccgggttcacgtcattctcctgcctcagcctcctgagtagctgcgactacaggcgcccgccaccatgcccggctaatttttttcatatttttagtagagacggggtttcaccatgttagccaggatggtcttgatctcctgacctcgcgatccgcctgcgtcggcctcctaaagtgctaggattacaggcgtgagccaccgcgcctggccggtactgtcccttttttatttaaatcatgtatttctagatttttctctggccccaagtgcaccaccagtgttgtctcagtttcactgttataaatcatttacatcagggatgttgaatccagaaaataaaatggcaaacaaaaatgacttatatgttttaaaaactatgaaaaaggaaatgatatatgtttgggattccattcaaaacgatcctgcagagttagggggtgagatgtgggtggggcctacataaaacaaggctagccatcaccagctagtggctatatgtctgggtgatagatgcatgggggttaatattattgatctctctgcttttacctgtacattagattgttttaatcagaaaatgaaaaaataaaactggggaaaaaaagaatagtagataaagaagcaaagagcttgggcaaaacatgtgaatttccccaaataattggagaaggaggatgaggtcagtgtattgctgtgaattctataaatgacccatctcgtgctttccaggcaatacccttcttgtctgtataccctctcgtcttgtttcttgcatggtgtgtgcagcagtacttgacattttgcagataccttttgcttgtttataattctcaggaccgctctttaaggtagctcatgactgcagtattcatcttatgtggaagggtcatttgtacaggggaaaccacagaggaaactgagccccagagaggcaaaggcctttgccaaggtcagataggggccccatgaccgaggtgtgcaggacaacccttgctgcccgtggctgctgtccatagtgctgccctcgtgggcctggcttgcttcccaagatctctcctgtctacctcccaggtgacactgccttcaccacttcttgggaatctaccataagcccatgaatcaagaaagacacatggtttagacttgaggagttatttttcccttatttagtaggtttgtaaatttcaaaatattagtctcttaaaattatattactttttttttttttttttttttgagacagagtctctgtcacccaggctggagttcagtgatgcaatctcggctcattgcaacctctgcgtcctaggttcaagtgattctcgtgcctcagcctcctgagtagcagggattacaggcacacgccaccatgcctggcgaatttttttgtatttttagtaaagacggggtttcaccgtgttggccaggctggtcttgaactcctgacctcaagtgatctgcctgccttggcctcctaaattgctgggattacaggcatgaaccactgcacccagcctatactactatttttttcatctcattccccaatatcagtgtttgatgatggatgcggcctcatcggttaggaagcttggtggaatactgcacccaccaaatgatgagcctgggtgtctatgggtgcccgctctctcaagggcacacagaaataggcaatatgtgcttttcttgatggctctaggaagtcaagaatattcatgtaaaataaccctggggcctagatcttttgggggaatgcgttaactccttcagtataacacaatgtcctaaaactaattaccagtgctataatggcatattcaaaagtttttaaatctcccaatatatattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgtcaaactgatgagtactatagctggagggtatagatggaaatagtactcatgaatgtggatcacaaaatgaagctaaattcttactattcagatatgatttgttcaggtgccctagaatttatgcatttggacaccttctgtgtataaggcactgttctgcattcttgatggggtggggacagcctcagagaggtataagacacagtctttatcatgaaagagctgagcacagttaactataaaagcgaagcacatgacatgtatcttagaagggctcctgttaagtaccacaggaggtcagagtagggatgtcagggcaagctacatggagggctggcttttagctgggcttggatgaatgcttagaatgtggacaagtggagattagagaaaaacaggtcattccagatggagaaaacttaccaggagcaaagcaagataaggctcggtgtattttttctatttcaggtagaaatgtaaatctacaagttgagatctattgaggtcatttaaaaatctatcatttttcaggctgggtactgtggctcacgcctgtaatcccagtactttggaaggccaaggctggcagatcacctgaggtcaggatttcgagaccagcctggccaacatggtgaaaccccatctctatcaaaaaatacaaaaattcgtcgggcatggtggtgcacacctgtagtcccagctaccgaggaggctgaggtgggagaatcgcttgaacctggaaggtggaggttgtaatgagccaagattatgccactgcactccagcctgggcaacagagtgatactctgtctcaaaaaaaaaaaaaatgtgtgtgtatatatatatgtgtgtatatatatacacacacatatatgtatatatatatgcgtatgtatatatacacacacacgtgtatgtgcgtgtgtacacacatatgtgtatgtgcgtgtgtacacacatatatgtgtatgtgcgtgtgtacacacatatatgtgtatgtgcgtgtgtacacatatatgtgtgtatacacatatatgtgtatgtgcgtgtgtacacacatatgtgtatgtgtgtgtgtatatacacatatgtgtgtatatgtatatatgtgtgtatatatgtatatgtgtgtatatatgtatatatgtatatgtgtatatatatgtgtatatatatatgaaatttttcataaattcttttcattatctattatcactgaaattccatcataccattaagatacatgcagaattgttctcactcataggtgggaattgaacaatgagaacacatggacacaggaaggggaacatcacacaccgggtcctgttatggggtcgggggaggggggagggatagcattaggagatatacctaatgtaaatgacgagttaatgggtgcagcacaccaacatggcacatgtatacatatgtaacaaacctgcacattgtgcacatgtaccctaaaacttaaagtataattaaaaaaaaaagatacatgcaaatttatgtctgttaggtatttaccatatggaaaaactaaaataatcaagaaaggaaattcagtaggtggttgacagtttaaatacaaatcacaaatgacatctttttaaatataacaagtagcttatttttaaaggtgtcacttactttgcaaaggataaggagaactgttattaagaatttaccaggttggaatggctagtgtttatgggagagagtttagcacaagacggagtgagacaagattgctggggtcttattttgaatccagcagccaacgctgtatggaatagtgaaaaagttgcctctttctgtgcttgttttctacttggtatctttaagaatgggctatttaggagcaaggagcctagcagaaagcatctgtcaatcttctaaaactttacctacaaaagttttactggcttgtgtcccaccagtgtgtttcaaagccagaaagtatattggccacaagcacctgtaggtggctgaggtgtgactgtagtcatccgtgagtcatgttttcagtatgtattgaaattccttatttggacttgatttcaaaggtagaagggccttttacaggtgaaggaactgagattgagacacatcaagagtctagcctcgagcttctgttcagtgtttttcccaaaattattgtttccttctggtctgggactctagagcaaagattgaaaactgtggcccaaagtgtgagccaaatccagccaccatgcgttttttttaaatcaagttttcctggaaaacagccaaacccatttatttggtattgcctatgtctgcttccatgctgcagtggcagagttgagtagttacaacagagattgcatggccagcaacacctaaaacatttattagttggccctttacagaaaacgtttgatgctctctgccttgcaacattgtgtacgtggtggtcagtgtgcttggaatcataggtgcaatgtaggatgcagacttagaaaacagtgcccttgctcccaaggaattatttgcactttagatgacaaggcatgtttgagacatgtgaaaggaacaataacaagttatgtaagagaggagacaggttctggactgcaggctatattttcagaccaaccagaatagttacgataatatcattaacataaataaaatactaagtatttagctacgtaaaagaaacgatttatttgcactttggattatacagttcttcattcattgattcaaaaattattgccagtctgctcatgtgccaggcattgttctagatgatagggcactgcatctctaaatgccaaatttcgtatccttgctggtggaaggcaatgtcctcttgctttatgccatgacacaaactaagctcctgctttaactatagacagctaaatcttaaacgaacacttttcagtcagtttagttttctcttaaagtactttaattccgttaaaacctgagccaccagatttcctgtctgcctgtctcttccttggccttaatccaaaactctgctgaggaagaagattcgttggtacactgacaattgttttataatccattcatttcataacccctcatttgctacccaaaagtggggacctaaatctgtacagatttacgtgttcaaaggccatggcctacccaaatagagaatatctcctttcttgtgtttctctcacaacttttgctgaagtctctccatctttgtgaacatgaacttctcgatttgtgaggctatcgctggtcagttgggtcattaatcctacagcaggcaagacacagaatttcctctcagctcaagatctcttcactcccaaccctcttagaacacacttcgcagcaatccttggaatctttaaaggtagccttttgtgactttaaaaaatacttttactatctctcaaggttacatccttaacagaaacaaaaagattctaatcagcgagacatcaagtctcttgcattgcttatttgtcacccaactaaaacaatgtactttcttgatttggttttattgactggatgaattatatatatacaaagattcaattagggaagcctctgaagtaagatgaagaaaaaagtatgaaactccagagaaagcagtttgaggcttatcctcaggggcttcaaggactgggagaagtcactgtattctggcatcttgcttctgtctccacttcctcccacagtgtttaatgctgctgtgaatttgtttcaaaggaagcctatagacttttttttttttttttaattttgtacatgagcctcaggagcagccttgacagctaaaagacctcgtaaaagagaagtgtgaagggattgcatgaaagtgctgggggcaagtctcagccctcggcctttgttggaaggtgtggggtgtgcagacacatgtgcaccttcgcacacatgcatctgtgcataaatatctgtgtttgcaggaaagaaaagatagggttgtgggatgtccccagaagccacagggattccagtgttttagtaccaggtgaaagagccgcttcctcccacactatctcagggagatgcccttctgtagacctctgtagcccagtaccctcaagagctcctggagacagatggccccgaacagtcctagggaagcagtgtgggcctgtggcaaaagcttggactgcgaagtcagcatgattggaatccggttcttgactcccaagcaggtgcataatgtccctgagcccttctttccttatctgtaatattgagaatagtaatacccatttctgggcccttttgactgttaatgagacaacatgtgaatgcatggcacaagaaagttaattgctacgtgtcactgtccccccctgcctcactgctgagctgccatcctgcccatctgagagggactgtgtgggagctgtgggtacagccagcacaactgcctgcagagccacgcagggcactgacagggaaggcctgtgtggggtgcccttcaaggccacctccgttttcttatttccttggagatttacttttgtgctcctgcttcccctccctgaagctttgcctgctgtccatatttggaggggatgaataagatgagcactggggaggggaggagccatcactccagcaggaatattcccagcggctgagtcactgcatttgattttcagtgtgaacaactgagaaatcaaagagccctaaaagaggaggaagtttcaggacaatgtttttaaaagataaaaaaacatcaacagcatggtgtctgagtggaaaataatagaaggggcttgaggagactggaaattccagtttgtgtaagggcgcacagtgctgtaatacagagtcctacctccctgcagtccctggatgtgaattcccaggctgcacccacacctgagcaaagcggaggctgggccttattaggttctgactgcgggctggatctcagctgcaggctgtgagtttcggataccggtgtttccaagccttctccacaccttatgtaatcacaggtgaaaaggtccagcctcatttgcagctgtggttcttctgccccaggaagccaggaagcgtagatttttgtattatttgcctccacttctccctcccccagcgtgccaccgtgcacatatgttttctgttttcctaagccacggcaaagcacaagcaattgcccattgtaaacacacctctgcgtatcaacacacacctggctgcactggattgaccaactttctgcttctaggtaatggctgatctagaatagaggaggaggaggggaaaaaaaaaaaaaacaagcagcagatggccccctgaatgttgtaaaccgtgtttctctaagcagggtttctcaacactctcgatatttgggccaaataataatttgtggggttgcttactatattgtaagagattcagcagcatccctggcctctacccactagatgctaggagcaccctgcaccccagtgtgacaaccagaaatgcctccagatattgccacatgcccccagttcagaaccatatttgtaaagcttagtagcaactttttttttcatatgctactttgcgtgttttgttgctgaactggaaataaacgttaatttttaggtaataaatttcaaaaaatgtaacagggacactcagcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaaattccaggtgagccgtggcaacaacctctaaaggatctaggaacctaaagaggatctgccttttatttaatagaaatcttagaaacaaaaataactgacatggcttgaatgtcaattgtttaaaaaaaaaaaaaaaaaaaggaaaaaaaatctattgtgtggtcaggcagttatttttatcatctaggcataatttttaccaaagaaacaaaacaatcaataatgttataaaagccacttatactctgagcttgaaacaactgctttatgccacaaaattcctattgctgtctccgttagtgactaattcaatatgtcctgaatgtcaacgtatttttattactcagctaaagttggctttgctggattaaatgtcatttaaaatgatcaattggcagcttgtttggggttgttttcacatttatgaaaggaaaagtttgccggatacaaatgttcttgaagctgatagggaaacggtgttctctggtaagccctgcccttccttttgccatctgataagtagataacattctaggtcctagtttgatgcctccgaaaaaccaacatggcagcccagtgcaggttaagcccttacattggagaaatggtctggttcacgtttcactgttttatgagaagtagaatgtaccattacagtaaaagagaagcaacagaaacatgcagtgaaaacgcccatgcttgtggttagagaactgtccgctttctttttgctctacagtaggcttctgagtggagtgccttccgcctagagtcaagagggctgccatgatgtcacccaccttcatatgggcaaaatgtctttatatgaaactgtaaaagacaaccaggtcgtttcttaattgctgaaatttattaaaatgaacacactagaaaatcacattcccaatccagaggaatccaatggcgtcgtcagcctatttgcaatggaaatgattgtaaacctatagggagacataggaggggctgcacacaaactactttcgttcgtcctgatttactggcttcttttccccctagagatacagtctcactctgtcactctatcgcccaggctgagtgcagtgggttgatcatggctcactgcagccccaaacccctgggctcaagcaattctcccacctcagcctcccaactagctgggattacaggcatgcaccaccacgcctggataatttttaaattttttgtagagatgaggtctcgttatgttgcctgggctggtcttgaactcccggactttcaagcaagtctactgcccctgcctcccaaaacaaacattgggattataattataagccaccacacccaaccctaatttacaggcactgtatgtgataatatgtgattttgtcagatgttttccagttggaagagattatggaaaattaaaatgtgtctgccatttgatagtaggacaaatactgaaatattaagccacagctgagttctggccttagtccttttggggctgctctgacaaactgccgtagactgggtagttggtacgcaatagatacggattgctccacagttctgggggctggggagatcaaggccctggcagatgaggcatctggtgagggcccactttctggttcatagacagcaccttcttgctgtgtcttcacttggtggaagggtgaggggtctctctcaggcctcttttaaaagggcactaatcccactcacaggggtggggcccccaagacctaatcacctcccaaaggtaccttggtagttagttaggatttcaacagatgaatttggggaggacatgaagattcagaccacagcagatctctattttccctttatagagaaagtaattcaagacaaggagatgcttacaagggaaaaagacactttgccactttttactgctttgcttagaaactagaatcatcctccttcaaatgcctgtaaaacgagctagattattctcagtctgcagtaggacactgatttctcaaggtacttaagatgcttgggttgctcatcttctccacacccccacctcagcccatcccctggcaatacagaatgcagccatggcaagacggggtgggcaatagaagtggctggacagcttctgttgttagaatggggttcaaagtccaggactatggtgttgttgttttaagaaggaggccacttgtccttttccaaaacacaatgagtgacacaccacattaatgtttaaacacagataatacagaagaaaggattccataagggatactaaagatttagggctgctgtacatttaatggtagttccttgaaagattaagcttctggaaaatgccacagttttctgccagtgtcttctgctattcaaagagaacgctggagttcagaaaagatacactgagcaggtgtactttgttctggaaagtcctaagattttataaacatacacccattaacgagtttctctgagactagaaattgcattgggaagtgtgtcatagcatgggttttggggtcatgcacagccaagaatcctgtgtgtcattcataagctgtgtcctcctgagtaaatcatcaaaccctctcagccccagcttcctgatctataaaataggaatagcaacagcacctgcctcataaggcggcgtaagggtcagatgtaaccaggcttgtcgaagccacagcacagtacctacaaatagcacccactaaataccgttgttatttttattactttctcttccctcccattatcactaatataataatcctgtaaagtaagtgctgttattcccacttcataagtgaggcaacagaacctcaggaagattaagaagcgtgtccagggtggcccaactgaattccccttgtaaatatacccccagagaagggtgtatgtttctctgcaatgcggatgtgttggctgtaatatattccaagtctcaactggacactcccctttcaaatgtgccaggcctaggccttgcccaaagtaaaaaagaaagaacattgtagtgcaggagtccagagtgcaaatccttgtgacctcaggcaagttatttcaacctctctgaggatcagaaataatacaggtaaagtgccgagttcatacttgtaattcagtagttgatcttccatcaccagccattctgacaagtgcctataaaaagtgggcatttccagaaccatgcagtgaacacctggaaattggtgctgctcctcatctggaggccagttaacctttaactcaacctagaaggcacacatctgtccccagctgcctctccaggttctgctggagggcaaccacacaccttcacagcacacatccagaaagtcatagaacaaggggaaggtgtacatcatgtcttcttctttttttttttttttttttttttttttttttttttgagactgagtctcactttgtcaccgaggctggagggcagtggtgcgatctcgacttactgcaacttccacctcctgggttcaggcgattctcctgcctcagtgtcctgagtagctgggattacaggcacacgccaccatgcctggctaagtttttgtatttttagtagagacggggtttcgccacgttggtcaggctggtctcaaactcctggcctcaagtgatccacctgcctcagcttcccaaagtgctgggattacaggcgtgagccaccacgcccggccatgtcttctcttttaatttactagcccacagccaaaaaccaaggcccaacaccatgcctagtccatattaaatcacctaacacttaataaaatatccattgcctgactaaatgttcaaacatcagttctgcaagtggagaaagtgacttttgcactgggttcctttctgccatgatccactatatcaaaacattttttaaagacctccaaaatgtgatagaatgagaatatctgtatctctttttgaaaccatgctagccacagttcccacagtcagagtcaccaagccacatagtttttcttttcccaccatttttcactcctcactcctttttgctgtgttttagcctaccccagccttctcatctttatccatccatctcccaccaacaccaggataaccttttcactccactattttttaccacacagctctctctgtaaccatcaggaccctctttccacccttttttccttccagcctgcatttaacacacattcagagcccattgattcagttagaacttgcctcccgtctttcacatgggttctgcccaggtttaagtttgggtcacgaccgtggacttctgggtcactgtatcatcatctgtggagggaggctgtcgcctggatcatctctgaggcctccggtgggtcaaaggtcacacaacaggacctccctccatctttctgggcctccgtttcttcccggtaaaacaaggaagttagttagacaatcagtcaacccaagctaggcagaagcagttgctggattcttttttgattcttctggttagtgcctcaacaagaaacattttcaacagtgttttcttgcccttttcctctgtagactgtagactgctttgggattacgtctatcagttgctttctgacagccggtacgaaaacttcatccgatgggaggacaaagaatccaaaatattccggatagtggatcccaacggactggctcgactgtggggaaaccataaggtaaaagggcagcagatatctgctccataaactagtgccaaaatgaagtccttatccctggattggaggataatcgtctgtcttctgctttttacgtctgcccatacttatttagtttattccttgctgggcaagcaattaggcagttgcaaagggaaggaaataattaaagatgcatcttgccatttgttcctgagaccaggtgcccattaactcacatatcctggtttgctgggctgcatcatgagtgactcttgtttccactccccttgacctgatcccgccacctccactgttgttaggaactgggtaaaagggaagtacagcaagactctctgactcacaggggacctttgggaagtgccactacttttctgctcagttagaaactcccatgttccccaaagcccatttctttatagaaaatacttagattctgactgtaaaacatcccctttataagcaagcgatgcaagaagtttgccccacaatttcccaaactgggaggagggaatggaattgaataaagtcttttgcagtaaggaagactgctcaagtgcgcagttgtaaaaagcgggtaaccgtgatccaggccagtcgataggtggacctgaagcaaagcctgatgttggcatggtggcacaaccccaatccgctgagtgagtgaaaaggcagggaggcccagccaggtgtgcccagacctgcagccttctaagaaggcagtgggtaatgcagaccatgaccaaatatggcaaggccccactgacagacacttccatgtgtgagtcactgagaaaaatccctctgctactcccactgtaccattgcctcgggcccagaaccactgtattcttgcttccacaacaggaatttaaacaaaagaattgtcttccttaaaatgacagaccagaaacacaagtttgagaaaaggtcattgcaacaaaaaaaaagaaatgctgtgtgggtcagaaggtgaagggtgacccagagatagggggaacctgcaggaaattcctcaggcggagcagagagcggtcttgggaaaaggaaataagcgaggctgctatgggatctgctttattagctagggctccaggacttcggacaaagggtgattcaccttaggagtaaaccttggtgacagtgaatataaaaagctaaagggtggggacagatgtgcctggaaggcagccgattagcaggtagcttcccaaactggcagggccacaggcagcagctgaagagcttttattttaatagctcccgcagtgccttttctgaggttcatttcattgtgtctttgtgctttttttctcccttcctcctttgaacaaacagaacagaacaaacatgacctatgagaaaatgtccagagccctgcgccactactacaaactaaacattatcaggaaggagccaggacaaaggcttttgttcaggtagcacttcctttttctcctttccttcttttgggaggatgctgttttctttaaataacggggagtggggggagactgttaagatctctacctgcctatcggatacccaaagccaatcattgctacaaactggataccaggtactggtttgttaggatttaaggaaaatatttttttaacttatgtctgtcctgtaataaagccaaaactaaatgaacagaatctgactcacctttaaaataacgcagtgaccaaataatattatgtggcattaaagtccggtgtagttaaaagcacaaagtcaatggcaaaacaaggaattaaacctagacttccaggttaccatcgctgtaaggcaactttctgaaccagtatttgtcaaaatgcaggtaatgacccacagtgagtcatgaaatagattgaatgggtccatcagagctttttttttttaatgaaataaggataggataggatagagttgaaaatgccagactgcatgacatgtagcaagaatgacagttgattcatgaaaatgttgttccaggtgtgtatgtacgtgatgagtcatgatgtaaaatgtatttcttataatgcatcgtagtcagaataagtctacaagctgctgcactagaatttttctttccagaattcctcatagataatgagttccaaccaagttagcctgccaccacatagattgtaattccaagtactatgcaagagaggagaaagaactggaagaagaaggagggatctgaaggaccaatcaggagatgtagaagtagacctctggtgctggtggtagtcattagcggggccaactgcaggttggtagaagtgagatcaacaaacacaaccttgggtgatgagttttggcaggtgggccagaagagagtggcagatggggctagagatgtagattgtgaattatctatatacaggtaggaagtgataccatgtatgaacagatgagctcactgatatgattaatttattggaaagagcagagaatctggtctttagcattgggaaggaatggtaacttaggaatagtaaaagcaattaagatcttcaaaagaaacgggaaaggctcttcaggaaagggaaacagaatagaaggaataaaaaaagaaccctccattctctggctctaccgtatggcttttcttcatccttcaacctaaacgcagtccttggctccctttcttcccactctatacctttttcgtggatgaactgatcccgacacacaacttcatttatcacctcagtggttaggctcttaaatctctatatccagctctaaaatctccctgaaattccaaatttgaatgtccaagagtttcctgtaggctgtgtccccttaaatatcacatttaagtatttcagacatgacatcttcaaaacagacacttgtctcggattagaaattccacccagaggccgggcatgatggctcacacctgtaatcccagcactttgggaggctgaggtgggcagatcacgaggtcaagagatcgagaccatcctggccaacatggtgaaaccccatctctactaaaagtacaaaaattagctgagcgtagtggcatgcacctgtagtcccagctactcgggaggctgaggcaggagaatcacttgaacccgggaggcagaggttgcagtgagctgagatcgcgccactgcactccagcctggtgacagagcgagactccatctcaagaaaaaaaaaaaaaaaagaaaagaaattccacccagaattattgaattctttactcatcaggggcatcactgctgtttgaagcagccaactttgaaactacagttccctttgactcctcctgtatcccagtcattgtgctagatggaccattggctcttcagcaccattcccactctattctgtgttgcaggggctagaagcctgggaactacatttcccagaagggactgttgccagaagttcccaggttggagtctttcagtgacaagcagtttcatgagatctgggagactagaaaaaagtaaaggcttccctggcagtggaagctgatgtctggacttcatgattcacatcgggattcactcaacaacgtctttctgtctctagtccactctgctgcctcctgaaaccataatacaaactgccagctgccctacaacactaatacagttccctatgccagaaatgtatatgactaacttttgcctttttaatacctacaccctcaaggctcaacctcaagtctgttgccctgaatgaggccttcttcagctgctccaacacacatagctgtcgtcttccatcatcacctgggtttcctggagcccttaactacactacaatttgctttttcttttcttttcttttcttttttttttttttttagacagagccttgttctgtcacccaggctacagtgcagtggcacaatctcgactcactggaacctccacctcctgaatttaagcaattctcataattatcatgccgtagctaatagtagctggaattacaggtgcctgccaccacacctgactaatttttgtatttttagtggagacagggtttcgccatgttggccactcttgtctcaaactcctggcttcaagtgatctgcccaccttggcctcccaaagtgcttgaattacagatgtgagccactgtgcctggccaacttgtttgtttttctagagacagggtctcactctgttgcccaggctagagtgcagtggtgtggtcatagctcactgaagcctcaaactctgggctcaagccatcctcctgcctcagcctccggagtagctagagcgactacaggatttatattttgaatacaggttgagtatccctcatctggaatgcttgggaccagaagtgtttccagtgtttggattagggatgctcagcctgtagttttatgtgtcaagtccttctccccgacaactagattataagctcctagaaggtagaggattctattttttatcattctatattaaacctttcagttaatgcttattgacagcctggtgtggaatatcagaagcttaatatgggaaagtcgtcaaaagaagaaaggggtggtttggggggccaagcataggacatctgtggagttggcttagaggggctctttattgacttcggatgtggagggagaaattttagttaggggataaaagaggagaaaaactgcagatgctacagatcatactgctggagaagtttgccagtaatgagcaggaaaagcagtagtagccagaagattgataggcttccaataaaagattttcagtaagagaaaggaatagtgctattagtgagggagagattagtccattttgaggaaatgaatgttagaagccagacttgccacaaaatgaaggtttcttggtataagacctagtatgtaatcaagtgaggtgttgaattgtagatactctttacaagatgtttgagtgttgaagaagatggaggtttaagtgttgaaatcatggactagtgccattaagcagctctttgatgaggagacagaacacaaagaatgagtaggactcaactcgtgagaagagtcaggagggctccagataagggaaaagctaaagatacatgggagagcatgcgccatgatttatacaagagccaagaccgctagactgcattgggttcatactgatgaacagtggaaaataagagcttcctaggtaaagatggcagaaagacccgatgagcagagcaaaggatgcacctttgacttgatgagtggtcattttaggcttttgcatgtggaggaatgagagaaaatgtaagctctaagatagtggcgcagggcagagtatatggggagagaaaggtgtgcaggcacagaaggggactggaacgggtgctcctacagtgtaggtggaacatctgcaaccaggctgccttcctgagccatgtaaattatggtcaaaacatgtcactgatgtcacttccagtttaacccattgaacaggaagatgaggcttgctgtacaccccagttgcaaaggtagacagactaaagagggttcattgctggcattttgggtgaatcagtgataacattgtaaaagatttttttttttttttttttgcccttccaattttccagaagctccactaagttgtcctattgtcagcatttttcacttaacatttaactatatcctttgaaatttaagtaagttttgaataccatttcctgggctcacagtctggaatggaagtggatatacagctctcatgagtctgtaaaatctaattctgtaaaagaaagaacatatatacatggtctggaccaaggctttctcgtgtggtcatgcattaatgcaccacgtgatcccaaagggtgctcactacgtcacagacagcctagacttttttttttttttccaataattaggatttcactttgtcacccaagttagagtgcagtagcatgatcatagctgactgcagccttaacctcctgagcttaagggattctcccacctcagcctcccaagtagctaggactacaggtgcacaccaccgtacccagatttttttttttttggtagaggtggggtctcgctatgttgcccaagctggtctcaaactcctaggttcaagttatcttcccaacttggcctcccaaagcactaggattatatgcatgagctaccatgcctggccctagtctttttaaataagcattttaccactttttagacagtcagagaaaggagtaccttttcctaatttgcactaagttaacattaatctcggggttcagtagctctccagctgtataagatgatggagtctttctttatatacaggctagagttcagagtgaagacagctttaggaaaatggaatctcttacctcctccacttcttcttccaaaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataa

SEQ ID NO: 295 - DNA, 109819 bp, Homo sapiens
cccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcaggtcggtgtcctaacctcccaccctcctccagcccgccctgtccccttgcagagcgggctgcctcccagactagggtcagggactgcggacgggaacgcacagaaaaagccttcaccgtgctagtaggaaaaaaaaaaagtcaccatctgtcctggcctcgattcccctgatggaagtgcgtgtgactgcaagctaagccagcgtgggcgccagtgcccttatttattttcaaaacagccgtttctcccagctacagcctcctgtttaaaagacgagctaattaatttttggctctagtgctcatggctgatgtagtgagatttggctcacacagtggatggattataggacctctaagaacagtctgtttcttaaaaacgggtgttagaggttccttttctgaagggatatgtgataggtgtccacttgctttgaaccctttagtgcaaaggtctccagaaacagctttttcttctcagaaggtgtcttggtccgttttctaatcttgtagaggttggccagacagcaggcactggtgttttccattgttgttctctgtccatgatttttagacttctctaagcgtttgagacaagaatgggaggattattgtgtttgcaatacagtgagtgttcaataaatagataaagcagctgatgtttaattgaggaccatttgctgctttttttgttacccacacgctaggacagctgggagtgctttggttaagctccggggttgctaacgcaaattggttaaatctggggcctaaaaagagtcgccgattttagaagttctctgttcttgataggagctgtaattcagaaataggcaagctaatagatctaagggtgtttcactttaaggtgtgactttcaagactagttcagacctacattctggggactggattggggcagctttgaatggtgagcagcatctactagctttgctacgtttttctatttccttggaagggccagagtgtcatatctgttataagaaatataataattgccacctttgacattcttgcctctatggcagggcagaaacatattttagggggaagcggtgtggcatctttttaatttgttttcttgcccatgaaccaacagcattcgagcatttccgatgttagaatttgcctattcccctgtgcccggtactttacatacatttacatataatttttgcagtaatcccattttacagataaagtagtagaggttagctagagtgttttgaagtcccctttcctctggtatctggggaaggaggaatcacaatttatagcaggaaagatttctggcatggcttttgtaaaatgttaggtaaattaccaaaacaggtaaataaatatttcttgaaaagaaataaaagcagcagagatttttctagaagagtgaatgccaagcctccggagacgagcttctaggaggcagaacagttctatggcatccctggattaacctttgagatatgactataatgagcctgggaatattaccttctagagcataaaacactttaaagattcattcttgtcccagtctggaagatatttgggggagaggatgatttcttggtctagggagtcctttataatttgaatcacttccctccaaatggattactttctcccaaggaacctgaattgatctccctctttgtcctccaaatttctgatttttgcctcagcctagaatggacttactggctatttttgccctggactaatgctataattttaagagtgagggggctgtagtcctagctactcaggcccaggtgggaggattgctggagcccaggagtttaaatccagcctgggcgatgtagtgagacttgactctttttttttttttttttttgagacagtctcactgtcacctaggctggagtgctgtggcatgatcttggctcactgcaacctccgcctcccggattcaagcaattttcctgcctcagcctcccaagtagctgggattacagggacatgccaccacgcctggataatttttgtatttttagtagagatagggtttcaccatgttggccaggctgatctcgaactcctgacctcaagtgatccacctggcttggcctcccaaagtgctgggattacaggcgtgagccaccgtgcccagccgccttgacttaaaaaaaaaaaaaaaagagtgaggaggctgaagcctcgggaataggccagtcattcgggggttgagaacaggtttttttcctggacttactaaacatagctggcttgatgtggtagggtggatagacagctttgcaactccagtgtcgcagagatgggccttgtgtaccaataacttgtagatgtctaattcctttcctaactgtctagcactgctgactttgggcaagtcacagttaaattttgtaccctttatttctcattttagaaatagggagatatatatatatatctcaagatagcaggagaattaaagagaaagtaaaaacaatctgcctatacttttgtgtgctgaaaaagaaaatatttagttatgaaagaagttcattcatgttatataatcctgtaatgggctgggcgtgatggctcacacccgtaattctagcactttgggaggccgaggtgggtggatcacgaggtcaggagttcgagaccagcctggccaatatggtgaaaccccatctctactaaaaatacaaaaattagccagatgtggtggtgcatgcctgttgtcctagctactcaggaagctgaggcaagagaattacttgaacccaggaggcggaggttgcagtgagccgagattgcaccactgtactccaacctggcgacagagcgaggctctgcctcaaaataaaataaaatcctgtaatgtctgagggtttttgttgttgttgttgttttgttttttgagactcttgctgtcttacccatgcagtggtgtgatcatggctcactgtggtcttgacctcctgggctcaagtgatcctcccatctcagcttcctgagtagctgggactacagtgtgcaccaccacatctgactaattaaaagaaattttttttttttttttttttttttttagagatagggtctcactatgttgcccaggttggtcttgaactcctggactctggtgatcctcccactcagcctttcaaagtgctgagattacaggcatgagccaccacacccagcctgaggtggcgtttttgtttgtttgtttttgagacagagtctcactctgttgcccaggctcaagtgcagtggcacgatcttggcacaccgcaacctccgcctctcgggctcaagtgattctcctgcctcagcctcctgagtagctgggattacaggcacccgccaccatgccccgctaatttttgtgtttttagtagagacagggtttcgccatgttggccaggctggtcttgaactgctgacctcaggtgatctgcccacctcggcttcccaaagtgctaagattacatgcatgagccaccgtgcctggctccagcctgagcttttaaaaatactatagaaaacagtttctataattcatccctgccaccccaaccccaactgcaagatagctacattttataaaattattctttttaatcactacaccaaaaactgctttggtgaggcagagatgcctaatatgcatctcctaagcagtgtaactttattttcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaaggtaaaggattgcgttttgttttatctgaacttgctggagacgtttgtgtagccctactactttccctctacttatccatgtatcttgctctctcatctcctttaggtctttgcttaaatggcatcttctcagtgaagcctttcttgatttccttaattaaaactgcagcccctttgcctacctgtttttctctatagcacttaattatcattgacctattgcaaatatctttatctgtctatatttctctgctagaatgtgagctccatgatggcaggtattttctcttttgctcactgttgaattcccagcacgtgaaatataatctggtataagatagggactaagtgaatgaatgaggttggaaatggcccttccctgttatattcccatggaaagattttcattcttatttgtgatctggacagtgggtggactagttcagatccatagagaaaaatctccatcactactgatacactcgtaattaatcctggcggcagttttatatgagagtgtgtgtttgagaagagagattacccacccaattagcatatactgtggtagttaccttttgaacgaaggccacaactttattatttttgtatctctattaagtagtggagattattttatattaactggtgtttctgctgtaagagtccttcagttctctcctccctcacccccaccaaagattaggaaataatgaacataaggccctggtttacttaacttggtataatacagtgtaaaacatcttacatttacatagctatttgaattaaaatgcccctcctcatacacatatcatccctttaattcttacatcattaaatgtgtttcaatgattggggtaagataagcttcttataagccttttataaggcagctggcatacacagaggttgtacttgaaccttcttcattgatgtcaaatcctatattacactgttccacactatttagaaaacaaaaacaaatggtgctttatagatgatccatatattgtcttattcttaccagtgcttcatctgtttcataaataaggaaatacaagctttcagtttcttttttattattatttaagttttagtgtacatgtgcacaacatgcaggtttgttacatatgtatacatatgctatgttggtgtgctgcacccattaactcgtcattcacattaggtatatctcctaatcaatttcttccctacaggcctgagagttagactttggtaaacattctggctcttatgtaaaacaacacattatatcatgttactcatcttttttttttttttttttttttttttagagttttgctctgtcacccaggctggagtgcaatggcttgatcttggcttactgcaacctccacctcccaggttcaagtgattctcctgcctcagcctcctgaagtagctgtgattacagatgcctgccaccacgccaagctaaatgtttttattattattatttttagttgagatggggtttcaccatgttggccaggctggtctcgaactcctgacctcaggtgatccacccacctcggcctcccaaagtgctgggattacaggcgtgaggcaccttgcatggcctactcatcttcttagttttcatgattttgaggaataatgtgattctctaaagaagttaacaatagtagggcatggtggctcacacctgtaattccagcactttgggtggctgaggcaggaggatcacttgagtccaacagttcaagaccagcctgggcaacacaatgagactctgtctcaacagataatacaaaaaattagccaggcatggtggcacatacctgtcgtcccagctagttgggaagctgttgtagaaggatcgcttgagcccaggaggtcaagggtgcagtgagcagtagtcatgtcagtacacttcagcctaggtgacagagtgagatcctgcctcaaaagaaaaaaaaaaaaagccggccaggcgctgcggctcatgcctataatcccagcactttgggaggccgaggtgggtggatcacctgaggttaggagatcaataccagcctggccaacatggtgaaaccccatttctactaaaaatacaaaaaattaggccgggcgcagtggcttacgcctgtaaaacagcactttgggaggccaaggcgggtggatcatgaggtcaggagatcgagaccatcctggctaacacggtgaaaccctgtctctactgaaagtacaaaaaaaattagccgggtgtggtggcgggtgcctgtagtcccagctacttgggagggtgaggtaggagaatggcatgaacctgggaggcagagcttgcattgagccaagattgtgccactgcactccagcctgggtgacagagcaagactccatctcaaaaaaaaaaaattagctgggtgtggtggtgtgcacctgtaaacccagctactcaggaggctgaggcaggagaattgctagaaccaggagatggaggttgcagtgagctgagactaccacttcattccagcttgggcaacaacagtgaaactccatctcagaaaaaaaaaaaatatctgcatataactttcaacttagccaaaacttaactactaatagccttctgtttactagaggccttactgatagcataaacagttgattaacacatcttttgtgttatatgttattatatactatattattacaataaagtaaactagagaaaagaaaatgtattaagaaaattataaggaaggccaggcacagtggctcatgcctgtaatcctagtactttgggaggccgaggaggatggatcacttcaggtcaggaattcgagatcagcctggccaccatggtgacaccccatctctactaaaaatacaaaaattagttgggtgtggtggcgtgcagctgtagtcccagctacttgggaggctgaggcacaagaatcgcttgaacccgggaggcagaggttgcagtgagccaagatcatgccactgcactccagcctgggtgacagagtgagacttggtctcaaagaaaaatataaggaagagaaagtatattaactattcattaagtggaagtagatcatcagaaagatcttcatcattgtcttcacgttgagtaggccgagaaggaggaaaaggaggggttagttttgctgtcttaggggtggcagaggcagaagaaaatctacgtataagtggacccacgtggttcagacccatgttgttgttcaagggtcagctgtaattcgttttatgattaatcactagtaggggaaatatctagaagacttggtgttaagggaagctaacctcagatttgaagtcatcactgagggctggccatggtggctcacgcctgtaatcctagcactttggaaggccaaggcggttggatcacctgagcacaggagtttgagactagcctggccaacatggcaaaaccctgtctctacaaaagatacaaaacttagccgggcatggtggtgggcacctgtagttccagctactcaggaggctgaggtgggagtatcacttgagccctagaggtggaggttgcagtgagccaagattgcatcactgcactccaatctgggcaacagagcaagactctgtctcaaaataaataaatcatcactgagtgccctgaaagtgaataattaatgtgatgcagttaatgcaatgcaactggacctggttgcattgataaatgagttttaactgggactttgccaccaactattatgttgtctggctttgtttttccacctttttgagccttggttattaagaacattgagaataggtgaggaaggaggaaggctagtaaggagcagattataggaagaggttatcggggatttggttaaggaaggtagagatgagatcatggctcactccagcctccacctcctgggctcaagcgatccacccatctcagcttccagagtagctgggactacagtgtgcaccaccacacccggctaattaaaatacatttttttttttttttgtagagacagggtttcactatgttgcccatgttggtcttgagctcctggactccagtgctcctcccaccttagcctcccaaagtgctgagactacaggcatgagccaccatgcccggcccgagtttcaaaaaatactatagaaaatagtttgtataattcatcccccccaccccaacccccacttgatgagagtggcgtgaatctagaaatgacaacatgtggctgtggccagactatagcaaacaaaaagccagtgagcattgaaggtgatgctcatgtttcacttgtgaagacgaaacatcttgggccgtgattaggaaagataggcaaagggggtggaaatgataagtttaattatgataatagtatcttatcccccatgcttctacataatagctattgttctttctgtttttatagattaaaatattgaggcctagagagcttaaattaattgcctaaagtcacatggctgtaagtgatagcacattttaagattgcatcaggacatagaataagacttagtttccaattctagcaaagcccattatagaaatcactaggatatacaggaactagcgtggtgggtatgaggttgtttgggttttgaggtgcagcatttgttgcagagcctcctgctttgacgttgttctgcctgataattaaaagccctaccctctgcctgctgggctgctgcaggggccaggcatcactgtcgcctttatactctgactcttttttccccctttcctgctttcaggatgaggccattcctcaaaatagtaaaaaggccacacagtgaagcctgtaccccccaggtttgatttcagaaagcttttattcaacttaatgacagtttattctttcaaaacaatatattgaagtattacacagagttcactattgtttcataatgtcatatgatgtaatgctaatgctggtgggtgatctgcagaggcagtggctgggcgagtttggggctatttgtatgactgaggtaatgtttgcatttttaataagcaagcagattctttctttggccttaacccttttgcataaatataccagagtataatttatgctccataatccaaatatctgttcctttttttatcaaagggatttctgtttttcatagcaatgtctgaattagtaatttattttgacatgtaaagcattttataggaaatgaaagattagaaaattagaaagtagctacaaatggctgtgacagaacacaaaggcaaaatagtagatttgatgtaagttagcaagattccaagaagttaacaaaccctgtatagatttcttacttgaaattcaaccactcatattttttaatgaatcccactctattgtatgtcattctaaagaaatgaaatatttgcaagagaaaagtaatatggttggtgttttatatataaagttacaaaaataattattcactcttagtagatgaatatgtgcatatttacacacatgcatgcatgtgacattctttccaaccgatctgtcatttttgttactgaccttggatacaacgtaagagattgtattgctgcctatggaaggggctgtttttgttaataacaaggatgatcaaacatatacagtgtagatactgaagtgatactaagcagctttgttgggagtttggtgtttggttgttaagaacatgatgcatgtgaagtagattttgataattaaaaggagcctggggcttttcatagtggagcgaaatctcatggaacagcagtgaaagctttcaaatcacatggaacattgagaactggaacctgaaagtgtagctagggaagaatgaagcaatggaaaaagggcgataaggagagcatgatggagctagatttcaaatgaccagtttcttcacattcttctgtcatctggacaaataaaagtctttgcattcatcagatgtctgcctctaccagctgtcagaccttatcattgcattggaaaatggcagccaaaggaggggacaagagaatggatcttaatcagagccacagtcttctctgaatggcttaaaggtaatctctaaacccaggggtaatcctaagtatattttctcccaaataccatattggaaagattgatgacttattcctgattactttatgggtttgtatttgtaatagctcttcagttaagcttttaaacatggctattcagagaagtgtgagttgtgtgtaaaaacaaaaacaaaaataaacatagctgtttaccagcattgggttagccttactcagaagagtgggaagtaccaggtgaatggttgctttcaaccgattgagaaagtgaagctgtctcaccagaacaccctcatcttttcccttactcccataaatctctgtgtgcctgcatccattcttgtttctttccattaagtctcagatgaggtattcatgcctttctctgaaacttaatgccattctgtttcactctttccatttgctgggactttgctcctgtccttttctctttttgtctcgcaactagcttagtggacctctttcctcttgttcagatatacagctcttcccatcttaaaaacagaagacgaacactttctttcaattcagttgccctcttggctaccacgctttctctgttctcatttctgctgccaaacttactgactccatgggtgctacatgctgtccctgcttccttgatacctctgccatttgggaagttcccctggacaggctctcatatacataacttcatccatatttgctgctttggaggattactagtgttttcttttcatgcttgaagtttttttctcagtccacatcctcctcttcttttccgtatttaacataggtttctatcccacttgttaaaactcccttcctttagtttatgatacctccccacccagtggtattctgttttgtttttttttttttaatctactggttagtctctattcctctctgcacagcattttgcctagtgctcttttggaaaaacaagattctaaggcgctttaagtattctgaaatgtagccattaagatgattttaagtctctgtcatcaacttcaacttttttttcttttccttcttcttttttttgagatggggtcttgatctgtcatccaggctggagtgcagtggcacaatcatagctcactgcagccttgacctcccgggcacaaatgatcttccaacctcagcctcccaaggagctgggaccacagatgtaccacacctggctaattttttttttttttttaatttagagatggggtgtcactctgttgtccaagctggtctcaagccctgggctcaagcagacctcccatcctggcctcccagagcactgagattacaggtgtgacccactgcacctggccagcttcaactccttgttctgtttgtccatcatcttgctctgtttgtctatacagtcgctttaaattcagcgtattccatcttccacttgtgtattatgtatttattcattttatttattcaacaaacactggatcttcttaggcaagtagtgtacacttgaaaagaatgtgttctgtagttaatgggtatagtgttctataaatatcacttaggtcaagaaatggtgatgttcaaatcttgtgtgtgcatattgatttatttcattaatttgatcacttaatgaaagagaggtattcaaatatccagctatttttgttaatttgtctattctggttattccattggtttctactttgtgtgttttgaaagtctattattaggcatatatgcattaaatattattatattgatccttccgtctttatgaaaatgtgctacctatgtgttattacccctgtcttgtagtctaatttgttttctatcaatatagccactccagctttcttacacttactatttgcatagtataccttttactattctttacttatttttatcgatttatgtctttatatttaaagggcatctcttgtagacagcatatagtagggtcttgcttttgtatttaggctatcgtctgctttttaattggtgtgtaaattgatatggttggatttaggtctcccattttgctcttcattttctatttgtgctgtgtgcttttggttactttcatactcctttcctgcttccttgcattacaaaaatttttttttagtatgtattccattttagtttcttttctggctctttaagttatactcctttgcattatttttttagtggttgctctagaggttacaatatagtcttgatatttattatagttcatttagaattactattgtatcacttcatgtaaaatgtaggaaactttcaatggtgtggtttcattcaccccccacttcttttttttttttttttttttttttttttttgagaaaaagtcttgctctgtggcccaggagggagtgcactggcacaatctcagctcactacaacctctgcctctccagttcaagtgattcttgtgcctcagcctcccgagtagctgggactacaggtgtgcgtcaccatgcctgtctaatttttttatttttagtagagatggggtgtcaccatgttggtcaggctggtctcgaactcctgacctcagttgatctgcctgcctcagcctcccaaaatgctggaattacaggcatgagccaccacgcccggcccaccttcacttctttgtgctattgctttcatatatattgcatctacatacgttagaaatcccatagtggttttatacacacacacacacacacacacacacacacacacacgtttttgttttaataatatattttttgaagtgattaagagaagaaaataactatatatagaatgtgatgtttacccacatagttaacatttccagaattcctaatccctttctccagtttccatttgatgtcatttatttttagtttaaaggacttcttttagcatatcttgcagtacaggtcagctggaaaaaagtcctgtttttatctatctgaacttttttttgcccacttttgttataaagtcattttttggtgtaattactaagtttttgaagacatattgtgagactccatgaaatctcattttttaatctacctttatttcatcagttataatatctattgatgattcttgcttgaattaattatgctgtgatggctaccaaataactgttttctaaatttttcattccttctacatttattagtttatattctattggaaggaataggtttctcatctccccatttatttattcaaatcagtgcgggaacagtcagctcctattttatccaatgagttgtatgtaatctgttattatcattatttctttttcaatctcaaaatgttccaaaattggccagtgacagcatcttcaatctaacttcctgtgtccttttttttttggagatggagtctcgctctgtggcccaggctggagtgcagtggtgcgatcttggctcactgcaagctctgcctcctgggttcacgccattctcctgcctcagcctgccgagtagctgggactacaggcgcccaccatcatgcccagctaatttttctgtatttttagcagagacgggatttcactgtgttagccagggtggtctcgatctcctgaccttgtgatccgcccacctcggcctcccaaagtgctgggattacaggcgtgagccactgcgcctggcctactgtgtccttttaacatattccccttatactttgaaaatgtctttattttctggcacaatataatgttccagacttattttgttcttccatgtctccagctctagaatcgggtatttcttaaaggaaccctggttcttttagtgaagggtcttatttagaatccatttctggaccttctcagaagatttagctagggaatccatagatacacacccacacatttacacctatgtttattttttatatgttcgtgtatttggcaacacgatcttgccctttcaccctggctggagtgcagtggcacaatcacggctcactgcagctttgacctcctgggctcaaggaatcctcctacctcagcctcctgagcagctgggactactctgcgtgccaccacgcccaactaatctttttgtattttttgtagagatggggtttcccaatgttgcctaggctagtctcaaactcctgggcacaagcgatccacctgcctcagcctcccaaagtgctgggattgcaggcatgagccaccatgcctggcctatattttctatatattgaaaatgacaagttcacactaatatgttctctatgttctttgatctgcaggtttgtacttttaatcgaaaactttggtcattatgtcttccaatatttttctgctccccccacctgctttttgtgggacgccaattcgatgttagaccgcttgatattttcttacacatcactgacacacctttcaatttttatttttagtcttttcctttctgtccttactttggataatttttactgctgtgtttccatgttcagtggtctttttttctgtcatgtctgtactgcttttaatctcatccaaggtgttcttaatttcagatgctggtatttttcagctttagattctcccccttaaatgtctttgatctctctgcttatcatgcttatgttttcctctactttttgaacgtatgagtacttcaattttattttaattttatttttaagagggagtttcgcccttgtcgcccaggctggagtgcaatggcacgatgtcagctcactgcaacctctgcctctagggttcaagcaattctcatgccttagtctcctgagtagctgggatttcagccacccgccaccatgcccagctaatttctgtacttttagtagagacggggtttcgccatgttggccaggctggtcttgaactcctgacctcaggtgatccacctgcctcggcttcctaaagtgctgggagtagagtgcatttcttttaaaatttacttactaattttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactttattctggcatatacatatggttaagttacttgtagtcatttggacccttcccatgttttcttttaaataccgttggggctcatctagtgcagtctttgcctagtttaatttcatctcactactaaggtgaaatccttctgagtactctacctgttgccttatgtattatgaagtctctccactgtggctaatgggaacatgagctcttcagaaaatatttggcctactgcttctctctagttttctccagtctctggaatttcaccttacaaatttacagatgatgttttcagagatttaagggtaccctgtgcagatctcaaggctgcccccttctctcccatattctgttgtgtaaatcctacccactttagtttctgcaaactttgctctctctctaactcagtgaggctgctgggctttttttgatgtccattctgctatggactgaatgattatgtctccccccaattcacaggttgaaattgtaatccccaatatgctgtattaggagatggggccttgggaagtgatttgatcatgagggtggagccctcatgtcatgggagtcacgcccttacaagaagagaggggagagaggttccttcttccttctgttcttagccatgtgaggacacaaggagaagacagccatttgcaaaccaggaagagtgccctcaccaaatatccaatgtgctagcacctaaatcttgtacttcccagcctccagaactgtgagaaataaatgtatgttgtttaagccatccagtttatggtattcttgttgtagcagcctgtaccgaccaagacacctccctggtctgcctcttggaaactgcctttaggtaataagctgggaaaatggtagggcttgttttccttctttcagggatcaaagtcctgtgctgcctgttatacagtatcggaaatgagtgtttcatatatttttgtctggttttctagttgtttattattgcataatagcagttaatccttcatgtgcagaggcagaaatccttaaaaaaatgctttttaatccatatttttctgtccgataccagtttttccattttacttataagaccctcctgccaacagcctttaattggtcattcatttctgcaacatattgataagcacctgctaagtgcctgatgtggtcagacagtgcaggtacaaaaaatagaagacatagttgctgccctttaggaccttattgttttgtgagcgatttagacaggtaagtattcacaataatatcatattagtaacactggccacatgtcccaaagagtagataaacatggaggagataattattaatttggcctgggaatttggggcaggcttcctagaggaagtagaattcagctgagctttgagggatgaatagcaggtagctacatagagaaggcagggttgcagagagtattcttttttttttttttttttttttttgagacggagtctcgctctgtcgcccaggcttgagtgcagtggtgcaatctcggctcactgcaagctctgcctcccgggttcacgccattctcctgccttagcctcccgagtagctgggactacaggtgcccgccaccacgtctggctaattttttttttgtatttttagtagagatggggtttcactgtgttagccaggatggtctcgatctcctgacctcgtgatccgcccgcctcagcctcccaaagtgctgggattgcaggtgtgagccaccgcacccggccaagggtattcttagtttaaaagtcttctatatatattttaaaacatatttaaaagatgctggccagtcacagtggctcatgcttctaattccagcactttgggaggccgaggtgggaggattacttgagcccagaagtttgagaccagcctgaacaacatggtgagaccctgtctgtactacagaaaaaaaaaaaaaagtttatctaggtgtggtggtgtgcacctgtactcccagctacttgggaggctgaagtgggaggatcacttgaccctgggaggtcgagcggtgttcatagcgctgtactccagcctgggtggcagaatgagaccctgtctcaaataaaataaaataaaataaaagatgccaaaaagaattcttaaccaggtcgggcactgtagttcatgcctgtaatgccagcactttgggaggctgaggtgggtggatcacttgaggtcaggagtttgagaccaccctggccaacatggtgaaaccccatctccactaaagacaaaaaaattaaccgggcgtggtggcgcacagctgtaatcagctactggggaggctgaggtgggacaatcgtttgaatgcaggaggcagaggttgcagtgagctgagattgcgtcactgcatccagcctgggtgacagagtgagactgtctcaaaaaaaaaaaaaaaaattattaaccaagtttgtatttggaatatactgcttttcttttcttttctttttctttttcttttgagctggagtctctgttgcccaggctggagtgcaatggcgccatcttggctcactgcaacctctgcctcctgggttgaagcagttctcctgactcagcctcctgagtagctgatattacaggtgcctgccaccatgcccggctaatttttgtatttttttatagagacaatgttttaccatgttggccaagctggtctcaaattcctgacctcaggtgatccatccgcctcggcctcccaaagtgctgggattataggcgtgagccactgtgtccggcctgtagaggaatcttaaaactgtcatagttggcctggtgcagtggctgatgcctgtgatcatagcactttggaaagctgaggcaggaggattgcttgaggccaggagtttgagaccagcctgggcaacatagacctcatttctacaaaaaatttgaaaattagctggtcatggtggcatgtgctggtaatcccagctacttaggaggctgagatgggaagctctcttgattccaggagtttgaggctcagtgagctccagtcataccacggcactccagcatgggcaacagagtgagaccctgtctctgaaacaacagcaacaacacagtcataggtatttaataacgtttaaatattttttccatcaaaattcagtttcacagaaagccagtgaaatgcaaagtgacattttaaagaatgcacttggatagataatcatttgcttctaccaactggtgaaaatcatcagcaaaagttagtaatcatggttttttttgtttgttgttgttgttgtttttgagatggagtccagcccaggctggagtgcaatggtgcaatctcagctcgctgcaacctctgcctcctgggttcaagtgattctcctgcctcagcctcccgagtagctgggattctaggcgtccaccaccgcgcacagctaatttctgtatttttagtggagatggggtttcgccatgttggccaggctggtctcaaactcctgacctcatgatccgcccacctcggcctcccaaagtgttgggattacaggtgtgagccaccatgcctggtctgtaatcctgtctctaaacatttttagcagtatatgaaagtgtcagtaagtaaatatttatgaacaaaaagtctgttttgatttgcaggattttcggaacaggtgacaattgggattgctttgctcttcagtcttttttttttttttttgagacagagtctcactctgttgcccaggctggagtgcagtggcaccatctcagctcactgcaagctctgcctcctgggttcacgccattctcctgcctcagcctcctgagtagctgggactacaggcgcccgccaccacgcccggctaattttttgtatttttagtagagagggggtttcacagtgttagccaggatagtctctatctcctgacctcgtgatccacctgcctcggcctcccaaagtgctgggattacaggcgtgagccactgcacctggcctgctcttcaatcttttttaattgagggcttttctctaacttaaagaatcagtatctttttatttcagtaaatcttatgttatgtcaaaattaatttttctcagccataggagaaggaaaaaataaatccaacagagagttaacagttacataggccaaaggcaaattaataataaatgccataggtctttctcatattttgccatttttaaaataagatggccttcctttagtgtagtaattaaatttatagcagtcctgtgtttaacaacacttttaccactagatgtcactagactaaaacaattggtaagcttgttgaaactgctgcaacctggtgcagtcttttcaaaggcctttggttaataaggcttcctctgtagcacctgcatttctcataaaactaagtcacagcttgcttcaagcacaagctgattgggaaatatacatgttctgtgacacgttagtaatctagaattacttattttagtgtttatcaggacagaaaaggacaaatcttactaccggaggaaactttttagtgaccttaattttttggagagaaaacgattttcagtctatctctgtactcagagaagcatttatcgtcacacctcaggtttctcaagagttgagattttgtccttttttttttttttttctcgagacggagtcttgctctgttgcccaggctggagtgcagtggtgtgatcttggctcactgcaagccccgccccgccaggctcaagcaattcttctgcctcggcctcccgagtagttgggactacaggcgcgcaccaccatgcctggctaattttgtgtatttttagtagagatggttttcaccatgttggccaggctggtctcaaactcctgacctcaggtggtctgtctgcctcagcctcccaaagtcctgagattacaggcatgagctaccatgcccagccaagagttgggattttgtcttagacatcgtggatttcttagggcccagcacaaagcttggcacttggtaggtactcagtaaatgcaattaagcattagggtagtatactagatgtcatgggggaaaagatagctcacaggtcctctgctctcaagaagtctcatttgggagataatacatgcccacagcacagggtattgtatgtaaaccaaatgagtagtgcattcactagcttctgtagtatttcaggggatcagtagctcttgagagctagcggtagtgatcaaaggtgtccttaagagaaagcatatttagagatgcaaaagtaggacagttacaagtgaagaaagcaatgagccaaggtttaaggataggaaaatgcaggcagtaaagatttagaaagataaaaactcaagggccctgaatttaaagcatacatttaggtttaatattttttagggatattggaggggacattgaaggatattggtgtgggaaaataatatgttgcatgatagtttgtaatttacaaaacaatagcacttgaagaagaatgaattaaagatgattgctctttgattttaaaatacttctgttttaaagtctattataggccgggcacggtggctcacacctgtaattccagcattttgggaggcctaggcgggcagatcacctcaggtcaggaatttgagaccagcctggccagcagggtgaaaccccgtctctactaaaaatacaaaaagtagctaggcatggtggcgtgcgcctgtaatcccagctactcaggaggctgaggcaggacaatcgcttgaacctgggaggcagaggttgcagtgagccaagatcgtgccactgaactgcagcctgggtgacagagtgagactccgtctccaaaaaaatacataaagtctactacaaacacttttatttaaaagagagaacataggcatagggcttagtatatagtacctctcacttaataaaccctcagtacatgattcttgttgatagtaatattattaaatgaggaaaaaatattagagacatgctacaaaataactaaccggttttctttataagagtcaaagtcttgaaagacaaggaacaattgaagaattatcacagatttaaggagactaaggagacatgcagtgtgggtcctggattgggtcctagaatgagaaaggatgttagtgggaaaaaagggcacatttgaatagttgtgtagtttagttgattatattgtagcagtgttaatttcctggttttgatcattgtattgcagttacatactatgttaatattaaggggaagctgctgagggtgtagtggtgagatcatgactcactgcagcctcgacctcccaggctcaagtaatcttcctgcctcagcctcctgagtagctgagaccacaggtgtgtgccaccactcccagctaatatttttaattttttttgtagaaatagggttccgtatgttgcccaggctggtcttgaatttctgggctcaagggatcctcccacctttgcctcacaaagtgcttgggataataggcatgagccattgcacccatctggaatcctatactttatgcaacttttctatttctttctttcttctttcttctttcttttctcttttttttttttctttttggaggcaaaaatcttgctttgttgcccaggcttggagtgcaatggagcgatcttgactcactgcaacctctgcctcccgggttcaagtgattctcttgcctcagcctcctgagtagctgggactacaggcacgtgccaccatgcttggctaatttttgtatctttagtatggtttcaccatgttagccgggctggtcttgaactcctggcctcaggtgatccgcctgcctcagcctcccatagtgctgggtttacaggcatgggccaccacacctaagcctgcaacttttctttaacttcttttgctttttttaaacttcttattcaaaaatagtaagtttaaaaatacaattttgttttagaaaagatttcaattttgtatttgaactaagttatctactgagaggtcggatgtcaacagaaagaatttagaatctcctacccgacagagcttttaagatccactaaagcccattaagcaatccactagaatagcttaaggcaagagtgggttcccttgaagacccagaagtagaacctctgaggtgcttccttgattaggctttgtctcagtggaatgttggagctagtttgattgtctatccagaccattaaaactttttatgtcagcactagggctgtttttgcctttgtgtgttcactggagtagcacttttaattccctttaagaacttgtcctttgcattcacagcttggcaaactggtgcaagaggcctgacttctaccctgtcttagctttgaacataccttcctcactctagcttttgatttaaagtgagagatgtgcaattcttcctttcacttgaacacataaagaccattgtaggggaattcattggcctgatttcaatattattgtatttcagggagtaggtccaaggagagggtgatagccgggggaatgattggtccgtgaagcagtcagagcacatgcaacacttctcagtttaagtttcctgttttctatgggtgtggtttgtggtgcccaaaacaattacaatagtgacatcaaagatcactgatcacagatcaccatgacagatatcataataatggaagtttgaaatattgcaagaattaccaaaatgtgacagacatgaagtaagcaccctgccacaaatcttcaatttgtaaaaaaaaacacagtatctgtgaagcacaatttaaaaaaaatttgaagtggaatagaatgaggtgtgcctatatatggaagatggcttgatctaatcagagataaaaagagatgaatgaggaccatatcaaaattatttccagtttgcagttaattctgctcccagtctccagtcctaggcaaccacaggccagcttttctggacacttcatctaaatggaatcatacaatacatactcttttgagtctgacttccagtttttgcctgttatgaataatgctgctatgaacctttgtgaccatgtgttcatgtgaatgtgtttttatttcttttgggtggattcttaggaacggaattggtaggttgtatggtaactttgtgtttacttttacgaaactgccaaacttttttcaaaattaccattttacattccttccagcaatgtatgagaattcagtattctctttatttctgattatagccatcagagtggttgtgtagtggtatctcattatggtttacatttacatttctctaatgatgttgagattatttttgtgtgcttgaaatacctgttcaaatctcttatccatttttaaattgggtttttaacttatattgtattataacaagttctttattctggatacaatctcttaatcagatatatgatttgcagtattttctcccagactgtgactttcttttcattttttgggggattttttttttttttttttgagaccgagtctcactctgtcgcccaggctggagtgcactggcgcgatctcagctcactgcaaactccacctcctgggttcaagcagttctcctgccttagcctcccaggtagctgggattacgggtgcctggctcatttttgtgtttttagtagagacaggctttcaccatgttggccaggctggtctggaacttctgacctggctgatattttttgaagtacaacttttttaatcttgatgaagttcagtgtatcaatatttttaataaagatttctcctagaagttttatagttttagtgattgcatttaggcctgtgatcctttttggattactttgtgtgtgttgtgtaaaggtctaagttcattttgctttgtttgtttgcttgtggtatccagttgaccctgtaccatatgttgaaaagattgtgttttcccttattgaattatctcagcacctttaaaaaatgaccataaatgtaagggtttatttctggactcttaggtctgttccattgatctgtcccatttttaatttcgtggattgtactttggtgttgtatctaaaaagtcatcaccaaatccatgcttacctagattttctcttgtattactgcttaggactttcatagttttgcattttacatttaggtctgcgatccattttgacttaatttttgtgaaaggtataaaccatatgtgcttttaaagactatatagtctgcagtcattgggtagagagttttatatatgtcagttatgttggttgatagtgttttttgagttttgtatattcttactgattttgtctttagttttatcaattgagagtgaggtactgaattattaacctgttttgttgaattgtgtatttttccttttgattctgtcagtttttccttcatttgttttgaggatatgttgctggtgtggatacatttagaattattatatcttcatgatgtaacaactttcatcattatgaaacaccgttctctaatattactctctgtctttatttctattttatctaatattaatagagccatttgtgttagtccactttgagttgctataaaggaatacccgaggctgggtaatttataaagaagagaggtttatttggctcacagttctgcaagctgtataagaagtgtggcaccagcatctgcttctggtaaggacctcagaaaactttcaatcatggaggaaggtgaaggaggagcaggcatgtcacatggtaagagagggagacagaggtgggggaggtgccacactcctttaaacaaccagttctcccataaactaatagagggagacttgctcggtactacagggaggcaccaagccattcttgagggatctgctcttatgactcatacatctcccactagaccccacctccaacattaggggccacattttaacatgagatttggaggggacaagtatccaaatgatatcactattctgtctttcttatggttctatgatggtatatatcttttttttttttttttttgagacaaagtcttgctcgacaggctgctgaagtgcagtggcgcgatctcagtttcctgcaacctctgcctcctgggttcaagtgattttcctgcctcagcctcccaagtagctgggattacaggcgcgtgccagcatgcctgtctaatttttgtatttttagtagagatagggttttgccatgttggccgggctggtttcgaactcctgacctcagatgatccacctgcctcggcctcccagagtgttgggattacaggtgtgagccaccgtgcccagtgggtatgtatctttttttatctgtttgctttcaactcttttgtgtctttgaatctaaggtgtgtcttttgtaaatagcatatagttggatcttgatgtttcatccagtctgacattctctaccttttgattgaggtataaaaaccattcacttttaatatagttattgatctggttagatttgcctttttattatttcttttctatacattcttgtctattttgtttctctgttcctccttgactgcctccttttatattaaatacatatttttagtttactgttttaactgttccattgattttttttaactatgtattttttggagttgttttcttagcagttgctgtagggattacagtgtacatgttaattatcagagtctacttcagattaatactaacttaattctggtaaaatatatatgctttgctccattatagcctcattctttcacccttttttgtgctattattctcatgtataatatctgtatatatttgtaaacccaaaacacagtgtcatagttacttccttaaggatgtttgtcttttaaagaagttaagagaaggtgtgaataaaaatatatttgtagaatcttctgtgttaactcacatatttacaatttttggtgttcctcagttcttcttggacttcaggtccccaaccgttgtcacttccttttaccctgaaaagacttttgttagtatttaatgttacaaattcactagcagattttctcagtttttgtttatctaggaatgtctttgtcttttttttttttgagggataaatttgattgaaatggaatttttggttgacaatttttttcccccagcactttatatatgccattctactctcttctagcctccattgtttcagacgagttgcttttctcttgctcatttcaggatttttttttcctttagctttccatagtttgtgataagtccaagttttgatctctttgtatttatcctacttggggcctttgagcttcttgaatgtgtggattaatatttttcatcagatttggtaagtttgtctcttctttccttctgggatttccattatgcatgtgttggcatgtttgttgttgttgcacagatctctaaggcactgttttattttctttaatcttttctctttgttctttagataatttctattttcaggttcactgattctttttcctgccatccccaaattgctattgagttgccccagtgaatttttcatttccattattatacttttcaactccaagatttctgtttggtttcttatttttaaaaattttatgtatgtatgtatttgtttgtttgttttgtagagacaaagtctcattatgttgcccggctggtctcaaactcctgggctcaagcaatgtgctgaccttggcctcccaaagtgctgggattacaggtgtgagccaccgtgcctggcctgctttttaaaatatatatataatttctgtctccttatagggaatctgaatttgtagattcattgttatatttttctttcttttattatgattttctgtagttctgtgagcttataattgctttgaaatttttgtctgctgtatctagtatcttcaatactcagaggcaatttctattgactgcatttttttcttgagtacgagtcacactcctgtttctttgtaggtcttataatttttttgttaagaactgggcattttagataatatagcagctgtggattctgatcctcccaaattgctgttgttacttttttgtctgttcattgctctttgtttagtaacatgtttgtcaaacctgtgaaatctttttcctgtggtttgtggccattaatgtctctacttttccaccccacaccctcctttttaaaagacgacaatcactttattatctctcagatttctgtgggtcagggattctggaagggctcagctgggcagttctgactttgttatgcagctgcagtcagttggtggctggagctgaaataacaggggctggagcagctgggggccgtctgggcagctctctttatttgtgtagtctcaggtcctctccatgtgtctgcttgctttttaaacttgcttatatctttacatctgctttcctaggggttgtccatatgtctgcatgggttaatagtcagttattgatcagaggttgtacttaaccaccttgatcaggaaggcttctgtcatctgtaaatggctctgcgtggcagggtagcacattcaaagttcaggccattttcaaatcttatcttttgttcactgctgaaccctttcacctctccccttggaatacacacaccctcagtgtcagctaggagcacgtgactggttgcaccctttcaggtctctgctgcaaatgcatacagccttagctaggagtaagcttgccctgaccacgaccacaacctcgtgttagtatagcttttggcactttccacttgcccatctctgagatagtcaattctactgatgacaccgctggatgtggatgctacctattgttccaaataagtcagcagccgcttcctgctaaagcaggaaagcttcctgttctcattacctgtcccattctggtacaacatctgcttcaactgaggcaggaaggttgggagaagcctcacatctcaatgacacagattctcactatttttacccaagttctttttttttttttgagatggagtcacactctgtcactcaggctagagtgcggtggcacaatctcggctcactgcaacctccaactcccaggtttaagcgattcttctgcctcagcctctgaagtagctgggactgcaggagcacaccaccatgcctggctaatttttgtatttttagtagagacggggtttcaccatattggctaggctgttctcaaactcctgacctcgtgatccgcctgcctcggcctccccaagtgttgggattacaggcgtgagccgccacacttggccaagttcattcatttttaaggcataaatgcttctcaaatttttatatgccattggttgattttccaaacctcaaaatggtttgaattatgtttgaatggtatgaattatgttcagctttatagttaccttttgcagagaggatatgttgatctcctcatttggatttatcaagaagtcccacttgtctgtccatgtggtttttttttttttggagatggagtctcactctgtcgcccaggttggagtgcagtggcgcagtcttggctcactgcaacctctgcctcctgagttcaagcgattctcgtacctcagtctcttgagtagctgcaattacaggtgtgtgccaccatgcctggctaatttttgtatttttagtagagacagcatttcgccacgttggctaggctggtcatggactccttgcctcaagtgatccacctgcctcggcctcccaaagtgctgggattacaggtgtgagccactgtgcctggccccccatttgcttttaatctagcttttaaagtagccagcatatagttgtcttgctgttttatatatgttgaaaatctgtctttttaatgatatctttaacactcttagatttagtgtaatttcagtgtggtggggttaaagtccactgttgctattttttttttttttatttgttctagttcgttctctttttttgagacaaagtcttgctttttctcccaggctctagtgcagtgttatgatcttggctcactgcaacctctacctcctgggttcaagcaattctcctactcctacctcagcctcctgagtagctggactacaggcacgtgctagttttttgtatttttcatagagacagggctccactatgttggccaggctggtctcgaactcctgacctcaagtgatccacctgcctcggcctcccaaagtgctgggattacaggtgccagccaccgtgcccggcctttgctcctgttctttattccttcctccctgcccacccatacctttttctgtctgctttaggattgagtctttttatgttccaatatttatctgcactgttgggttattatttttatgtatgaatatatgtattttttttctagagtgcagtggcacaatcatagctcactgtaaccttgaactcctgggctcaagtgatcctctagcctcagcctcctgaatagctaagactacaggcatgtaccaccatgcccagctaattaaaaaaaatactttttttagaaatgtggtcttattgtgttgttaagactggtctcaaacacctggcctcaagtcatcctcttgcctcagccccctgagtagttgggattgcaggtttgagctctcatgcctagcaagattcattatgtggttgtatcaatagtttgttccttttattgtttccttcttatggatataccatagactgtctatccatttgccagctgaaggaatcggggttgtttccagtatttggtgattataagtaaagccaacataagttttgtggcagttacaatatatgacagaattgcttcccaaaggatttaataaactaattcatagtaaaaacaatactatctgagcatttccatttcataatatcctcttcaacactgggcattacttaaggatttgttttctccaaaatggaagtatcttttattctgatcatgaaagtaacacgtgctcatgattttatgtcactcagccctctgatccgaaacctaaatatactccattttgtctcttttgttagagcatgacccccagaattggcatagtgttccaggtgtggattggatccagtgtcttttctgcatgatatattccttttaatacagcccaagtttaagtagcttttttggcagccacatgcacttgagtcatatcgaatcatctaaaactctaaagtgtttttcacatgtgctgacattaagccacacctcccccatcctgtatttctgcagatagtttttggaccttcagtgaaagactcacattcatccacagttcagtgtcacatgtagcctcagtttctagcttgttgaagccttttttgaatccccacgattaacacaccatgaggggcctcactcaagtcattaaagaatgtttaacacgacagaacctaggtcagagatccagggaaaagctcatcacagtcaacagacacagaactctttctgttaagaatacttttttattttccagtttctagttggtatttttgtgggaagtaaattgctatctcatatgcgattagtgagaactaacatttgtgattattatattaattgagactctttttggtatctgattatcagtaccatgcttattatgtatatcattaatgcagtttttattgtggtattttatcaccacaaactgtatttattactagtctatacttatttaaaacattgaagtgtttttcctgagactttaaaccacatcctaagaccacacttcccaaacatatggtagcagtgaccagagacataaaaatcacaccattgatgagagagtaatgattctaagacctgccccaaacctcaaataggatagcaatgtcatggctgctcctaatttagatgggacgaaatcaacaaaaaggaactgctggccgaggatagttaatattcaaaagcaaaagaaatgtatctgtaaataaggaagataaatctcattataatatccactgcttttttttggatgtggtcttccagcagtagtagataagtatattattaatgaaacaattgtgttagtgttccataattatacaaaaagggaaaataggacaaggcatgaataattaatgaaaggaaaccagactcttaagtggggtgggggggacatataagaaaaggtaacagccatctgtgagtctggtctgaggaccagaggatggctgacatttttggggccagatagactatctttctgctgttcttctcctttcctggcaatatactggaagagattgaaacagaacatcaaggcaaccccacacatgagatggaaatttaaaaaatgttccagatatgagcataactccctaagccattcttttagcaatggttgaagccagtcctctgacttgcagtaagttctcgcaagaggctacagttccgaggcctatttattttggcctcatttttatccctacttttactttggtgacattccttgagtctcactcattccagcatagggacaggacacaggttgttgaggcaaatactatgggttcatatagaaagtaccagatattaactatctctggccagagtttttcccctaggtccttacaagtaagtactttttttttttttttttttgagacgcattttcattcttgtcgcccaggctggagggcaatggtgcgatctcggcttactgcaaactttgcctcccaggttcaagggattctcctgcctcagcctcccaagtagctgggattacaggcgcccaccaccacgcctggctaatttttatatttttagtagagaccaggtttctccatgttggctaggctggtctcgaactcttgaccttaggtgatccacccgccttggcctcccaaagtgctgggattacaggtgtgagccaccactcccagccaaataaatatatttttaatgcacatttacaattctaattagttttatatacctctgccagtatcttttaagcccaactgaagttatgtgattcctctgcagaattggttgctccatcctgcctacaaccaattctgatgcaggtatgagctcctcagcttgaggtgaagatctcaagcagcctttatcttaaaaaatttatttcgttttatgtatttattttttgagacagagtctcgctctgtcgcccaggctggagtgcggtggcatgatcttggctcactgcaagctctgcctttcgggttcaagtgattctcatgccacagtcacccgagtagcagggattacaggcacatgccgccacacccagctaatttttgtatttttagtagagacagggttttgccatgttggccaggcttatcttgaactcttgacctcaagtgatcttcctgtctcggcctcccaaagggctgggattacagccatgaggcactgcgcctggcctcaagcagtctttaaatcttcatttcccactgtgtgctttgtattgagctccaggccaaatcggactgttttctttgctttcccacctctaaactttgcccatgcccttctatctgataaaaagccatcttttccacataggcctgctaaaatcttttcattcctttaatgattcctttttagattcctttaatctatcattccttcaagattttgcttgttcatttgttcagcaaatatttgagggctgctatgtgttaggcactgttctaggaggtgagggtatagccaaatacacaatctctgctttcaaagagcttacattctaatagttcatcccactagaaggcaagtttgtcttagaccatctccttcattatcttttttacctttcctaaattgatacaatctttacatagatcatgatgaggaaggaggtaatatatttgaagtgaccactgtggccaagcacagaacattgcaaaatgctttaattttaaaagcatgtgtcctaaatgtagaaggaaggataactagaaatacagaaagttatggtcagaaagccgggggtggtggcatgtacttgtaattacagctacttgggaggctgaggcaggaggatcacctgaggccaggaatttgagaccagcctggtcaacatagcaagaccttatctccttttttttttttgaccttatctcaataaggtggatgcacctgtagcctcagctacttgggaggctgaggcatcaggattgcttgagcccaagagttccaggctgcagtgagctatgactgcaccactgcacagcagcctgggtgacagagcaagaccctgtctcttaaaaaaaaaaaaattatggtcaaagcaaaagcagtaataagtaggatgaccttagatgatccaccttccttggcctcccaaagtgctaggagtacaggcataagccaccacgcccggcctaaactgccatttttaatgaattgtaaagaacagaagaggtaccagaagcttagaaatagaaaaaagtacacgttaaaaggggaggcgggtaattgaacgaggggccatgatttcaaaatttccatccattggttccaactctgtgccttcagcgcttgttctcttttaaagtattgatagactactattgtgcatccagtcagtcttgttttgtcacactaaaaatttcaagataagtccataacaggagcataagtaagatactgcaaggttctgaccttggcctcaaccttactcaagatcatatcacttagcttggttcctgccatacttagcaaaggaccctatacatgctagatacttattgaagatttgtggactggacttaaataaagaggtagaggcatatcaatcacattggtaggtggtaaagtgttggacagaatatctgacacaatggatgacagaatcaagggtcaaaatgacctttttttttgagacagagtctagctctgtcacctaggctggagtgcagtggcatgatctcggctcacttcaacctccaccacctgagttcaaaccattctcctgcctcagtctcccaagtcgctgggactacaggtgcacgccaccatgcccggctaatttttttgtatttttagtagagacagggtttcaccatgttggccaggctggtctcgaactcctgacctcaaatgatgcgcccgccttggcctccgaaagtgctgggattgcagacgtgagccaccacgcctggcacaaaatgatcttaacagactgaaaagatggtctgaaaccacaatgacatttaaaagcaatacagctgggtgcagtggctcatgcctgtaatctcagcactttgggaggccaaggtgggcagatcgcttgagctcaggagttcaagaccagcctggccgacatggtgaaaccccgtcactaaaaaaaaaaaaaaaaaaaacgctaaaaatttaggcaggcatgggggtttgctcctgtagtcccagctactcaggaggttgaggcatgagaatcacttgaacccaggaggcagaggttgcagtgagccaagattgcaccacagcactccagcctgggcaatggagtgagacttcatttcaaaaaaaaaaaaaaaaaaaaatagagacaaagctaaaatggtgcagctctaagtccaacgatcataattgtttaagttaaagggatttctgcacacagcaattatttgttgagtccccaatatgtaacaaatacacactactcaaataaattaatcctcccaataaccttctgaggtagaggtattagtgtcccttttagagatgaggaaaatgtgatccaaagaggttaggtgacttgaccaagatcctaaggccaatatacgacgttttcgatctctgaattatctccaaagtctgtgctttttcctatcatgccacactgcccctctgcactctcatgaattgcaggaatttattccaagttacaaagaatcattccagttctgcttaaacatttctagtaattaagatagtttaatactatgcaaggcagcaaaaaggttacagacatagacttttgagaacagtcagatccagattaagaacagctgctcagccacttcttagctgcacaacactggacaaatccttatctctaaacaacagtatccttatctataaattgagactaaaaagtacccacatgacaaggatgctgtgagaattaaatgtgagacgctgtctgaaaagtgcttagctcactgtgtgacgtattgcaattgcccaataaaaattaccattcaaattattatagaaagttctttttatcaaaccaaactctacctcccaataatttctgtccactgatctcagttctgatcactgggactttataaaattagatcaaatcctgtatctatttggcacccatgtaatattagaagagggttatattctgagtcgtctcttctgcaaaccaaaactgtaatctgcttcaaatctccttcataaaaaaaggtcggccaggtgtggtggctcatgcctataatgcaatgccagcactttaggaggctgaggtgggcggactgcttgagcccaagagttcaagaccagcctggacaatatggcaaaactccgtctctacaaaaaatacaaaaaaattagaccagcacagtggtgcatgcctgtagtcccagctacttgggaggctggggcgggaggatccttgagctcaggaggcagaggttgcagtgagccgagattgtgctgctgcactccagcctgggtgacagagtgagaccttatctccaaaaaataataataagacaaggtttctggacaatgacttctatcactcaactcaggatgtaccctagtttaaaaatctcttcttaaacatgacacccagaatactctcgcaggtgtacagtaaccattgccaggtgcctgggactactgcttccactttctgaacttgagatcaaaaaagcccccactgaattgctgttgagccagttttcccacaccctatccttatacaactggttatttttcatctaaatgcaggactttacaggtactgcttttaagtgtttttgttttttgttttttcagatagggtctcactctgtcactcaggctggaatgcagtggcatgatcttggctcactgcaacctctgcctcctgggttcaagtgattctcgtgcctcaacctcctgagtagctgggactacaggagcacaccaccatgcctgcctaaattttgtatttttagtagaggcggggtttcaccatgttggccaggctgttcttgaactcctgacttcaggtagatctgcccgccttggccttccaaagtgctgggattataggtgtgagccatcgcgcccggcctttgtctctatttttgaacattagaattacattatctctcatataatacatgctaatataccaattagaacagaagttttgattgctagacttgattttgtttacaatttggtacagatcaggtgtgtatgtttactttttatggtttttctttcattccccttgctgatagcaagtagcagctactgtcagcttggaaaccaaaataaaatcaatagccctcggccgggtgcggtggctcatgcctgtaattccagcactttgggaggctgaggtgggtggatcacttgaggtcaggagttctagactacactggccaacatggtgaaaccctgtctctactaaaaatacaaaaatgagcctggtatggtagtgcacacctgtaatcccagctactcgggaggctgaggcaggagaatcacttgaacccaggaggcagaggttgcagtgagctgagatcatgccactgcaccccagcttgggtgacagattgagactctatctcaaaaaacaaacaaacaaaagacaaaccaataggcctctgaggcagtctgaagggcttcctgttattaaaatacacaggaattaatacatgggatttaactattttggtgacctgtaggccatttttggttttccctgtttcttggctgttcagggagttggaattattaaataagtaagatataactggatgtcacataatttttgccgccctttaaaaaaaaaaaatttaaagagacagagtacgttgcctgggctgaactcaaactcctgggctcaagtgtctgccttggcctcctgagtagctgggactacagatgtattccatcttgccaggctgatttttgctcctgaggattacaatctagtatagaaaacaaacctcatggttgacttaaagtgtaggattttacaagcatagtgttcatttagtagtgtataatggtatcataccttctgtgtggagtgcctgtttcccatgtgccaagtgctacactggttgtacttcatacaggacctttgcaagtcttcaaaaacaatcctatgagggaaatattaacatcatccacatatagataatgctgagctacagagaggttagacaacttgctcatcttccaaaaagatttaaactcaggtctgtcatagtccaaaggccggatggtttttaccacaggggaagaggtggaccatagtcataggaaacaactgtatatagagaggaatgattaattgagctgaacctaaaaggacaggtggggttttggtgtgatgtgttaggttgggttgggaaggtggatgaaggagttctgggctggcaagagagtctgagcaaagtgggtctgaatatcctgcattgaggagatggggtggtggcagagtgatcactctgtgaccaaagagaaggctgcaatttgagagggagtaagaggatgagacaattattattattattattattttgagaaagagtctctctctgtcacccaggctggagtgcagtggtgtgatctctgccactgcagcctccgcttcccaggttcaaatgattctcttgtctcagcctcccaagtagctgggaatacaggtgcgtaccaccacacccagctaatttttttttttttttttttttttgtatttttagtagagatggggtttcaccatgttggccaggctgatctcgaactcccgacctcaagtgatccacctgccttggcctcccagcgtgccgggattacaggggtgagctaccatgcccggcaaggtgggaaaattaggttagggccagatttggaggctcctaaaggatagggaaaggaatttgaagttgatgccataagaacgtgattgtagttttgtttgttgcagtagggagcagggtattaacatgttgacagctgcgctttttgaatgaattggtatgacagtggccaaagatggacaatgcagttaggagattgttgtagtttcctagtgatgagctgatgaaagcctgggctggggtggggatagtggaaggaggagcaaacttgagaggcattttcaaggaagaaatgacaggatttggcaaattgggtgccaggaataaaaagacggggaaatagccatagggttgcttgattgagggagcagaataatggcagaatggggaagggagattaattttgtttgtttgtttgtttcttttggagatggagtctggctctgttgcccaggctggagtgcagtggcaccatctcggctcactccgccccctgggttcaagcgattctcctgcctcagcctcccgtgtagctgagattacaggcccacattaccacgcccagctaatttttgtatttttagtagagatgggtttcatcatgttggccaggctggtttcaaactcctgacctcaagtgatctgcccgcctcggcctcccgaagtgctaggattacaggtgtgagcaaccgtgcccagtgggagattaattttgaattttggccttgtggccttgcaaaaccacaactagtaggagccgtttcactgatgcatactcaatgctccctagcctagcatccgcacaatgccttttctggccatggcggagagcacttcaaaaggaggccctgcggagggtggggtgggtagaggagcatggtagggaatgggaggggcaggtgtcttccaaagtttgcagttctcctaacttgttttgccctaggtccgctgaatgcagtattacagtcatggcaaatgtcaccgtactgatgtgcttaacatagatgtaatgttttctagagggtacgctaaaactcttggagggagtggggggtgggggttataaatctttatgttatttttctgttaatgtcaaggaacagttcatccttctgggtctgtatgtttaaactgagagtgaatattaataggaatttacggtactcatgttggaaattgctaccctcatttagaaaccattaacctttatgttaataaaataatgtttttaaatgagcatatgaaatctgtgttgaacagctgcggtctttccggaacactaacttaaaaaatgctcagcatactttttgaaaatcaaaagcatgtgggtgggatgaagtcacctgagcaattttctataattacaactttcaaggccttttcctttgtctttttccagctaacctaaaatacacatgcacgcatgtgcaccctcacacagacagcagcacaaacctgtgattttcttctttctctctatggactttttggccttgtttttgttaaatagttgcagttccctaggaggatatgtgttgtcttgttccttctctagtttatttgaaaccttatatctttgagaactttggaactccccagaacaggctagatgtccacctagactcccaagctttgaatgccctgtcctaaagtatttctaggtgcgttggatctaaactgattcccctagggtgacagtggaaaccccaaaatgccgacatcctagagaatgaccaggaacatgctcaagttgttacacagttttttgtacgtgctgaggttcctcagtgccatcctggtcagccagtactggaatgtgacagaactggcatttgtgcccaggaacagcctacgctgggaattcgcttctgcattctgataattaagtctgctgtgctgctaatattgttccctgaaggaaggagagctagggaataatatcattcccacttgtaccttttaattaacagaggagtggaatggaaagagttttaaagaagactttgatgagagaagatcggtacctgacatagtctggtaattccatcattgtcgaacacattttaagaataccaccgccagttttttcagtgagctaactgaaaataattctaaactttggcttattttatgtgtagaataaaattattgattttccaagagcattcattaagaagtgccttgctaagaagtgttaagcgtgaagtagtgtaatatgtctgtcctactattttaggggtcactccttcttcatcttcctcttctctttcctctaagtaaccaaagctcttcacctagaatggaatttggggcttacattttccttactatcatatagctgtttcttgttaccgaaagcagagagagctttttcagggaggttaaaattatcgttatcttgttatagtgttattttttccttcttagtaagttaggagcaatgctttgtcttcctgaagctgtctgaaaagatgcttgtatacatgtgtatagcgctttgggtcatagaaattaggtgttatgtcatctgtttcagaagatgcactaatgcatcaaaaacaagtgacagggaaaacaatgcagtgagtaatcttgttgcctcaaaactgagcaaacgttttgggagagcaagttcttgcgggacatcactaaataagaatgagttgatgtcacacttggcaagaagcaactctttaaaattttttttttccatacaaatagtacaacatgactgggaggagggattgtgggcaaagggtaaagaattatggagggaaaatgagcaggagaaggaatgtgagaatgagctgcttgctacaaaaataattaatatgtaatcaaagccatgtttgttttgtcaggaaaaatctgagtcagaacatgagctgatgaaggggagagatgtttaccatgtcctcccccacaccctcagagggccgttgtgtgcagatccctgcggagggttgtgtaaccatcttgactcattttcagggaagaatggcccctgtagctcttttggctcaatataatgctgcatcaaggatgagtgaagaagtctctggaatacagtgctatcaaactcaaaatatggtcattttaatgagaatttccaaacactaggaggcaatactgtgcagaccttgtgccaccacctgcctcccccttcccagatatctgtgcgatattgggaattcaggcagcccaatcgatagctgattttaccttttcctacaaggcagaaaatgtcaagattagccaactatttattgaaattagttggagttatctggctacatgagtgtctgtggtccagtgtatcataataagagtgggagagacggttggggtgctactggcatcttgggtgggccagcctttattgtgtgtcactgccgtgtattggcaatttttgtccctgcccactgaattgccagtggtgccccagtctctgcgatggccaggagaggccttccttcttccagattacctctgtgtgtttcaggggggctaaaacagtatgtgttttacagtattactaagcagcacagttttctttgttgttccttagcataaagatcttggaaagttttaagaagttgtgtgtttatactgtagcataggtttcattcaacctatcactcctattcactcctcagagtgaatttcagggaaaaacaacagtattgggggaaaaagtttggaaaaattggatggagggaaggaaaaaaaaaggtgaattgcaaaagggtttcttacgtagcccactattgttccccaaatcaacactcactctccagctctttgggtggttgctctgcattttcaagaggcagcctggggtggaggtcagggttgcaggtaaggtagaggggaaataagagaggacagggaagaggcaggcatgaataaaagatttggattggaatataaagatggaatacaatggagataatgaaagaccataacaaagaaacaggagattttacatggcattgttaagcttacaatgttggcattttggggacaattctgagtaccacagatctagaacttctaaaagaaaaaccctctgagataattacagcagttaaagaccttcacatacatgttgaattaatagtatttaatgtccctttgtaggtttcaatcttttaagcctgtcctgccaaagactgtgtccttctaggtgcttagccagtaatttaggtgtactgtcaccagttgtttccgtcatgacttctaagtctcagcagccattttcccttaggttttattaactgagtcagtaactcaaagtgtcattgttttccactcatctggactttctgaaaataacacagtgctttattggaaaagctaagcatagacattagccaaatgtttgctaaaaattaaccaaattaaatgttattaaataagatgtgcaaatagaggaaaattttgagaagtatgaacaaatcccactaatctttgttgtcagtcactacttagaaccttggcttcgcaccaaggctgaattaagttgaagaatgttttccgtaatgcttcccctaccttttaagttggtttgaaaacattcagttgcatgtgtaccactggatttttagctttttcactagttgttaccctggcagccttgattcagtgaaaatcttgtttttatcacaggctatttctctgagcagccaatgtttcacgctctctccctgtctaattgtctggccttggtaactcttagcaagagttgaaattacctcggtcaaccacatgacaaaagagtgggcatgggttttcctgaatgtctcctgaggtgaccaagggtggagtggtggtagcataataaaccccatgggaagtggagccatagattccatcagctttgcagaggggccttagacccagcagggtttaagaaactgctgtggataggatgccttgtcctccatagagattatcagctgctacctagaatttctttttcatttgcagtatgtcagcatacagaaaaaaaaaaaaaaatagcaaacacctgtgtattcatcaaatttgtcatattttaatattttgccatgtttgcttcagatctctttccctgcaggaagaaaaatacacgtttcaaataaacaacgccccctccccatcctttatatccttccctgatattccctcctcctcccactccacagggaattattgatctgattttggcattcatcatgcccatgtgttttcttcgtggcttgtctttttcctacatgtttttgtatatctaagcggtgtagaatattctttcacttgttttgactttatataagttgtgttctatatgtatccttcagctacttgtgtaactttcttttttcttttccttataattttgagatttatccatgttgatatatgtctcacttattttcactgctgcgtagtattccatcaaatgaatatttcacagtgtatccattgacttattagtgaatatttgagttgtttccagttgttttactattaaacagttttgcagtggacatctttgtacatgtctccttttgcacatgtatgagagttttctctagggtatgtaactaggaacaaattgctgtctagtagggcacatgtattttcagctttactagatacagtcaatttactcttcaaagtagttatgctcttttatcgccttactagctatatattagagttcctgttgttccacatcctcagtaaaaccggatattgtcccagctgttccttgcttattgattaatttaaagacaacatcgtgcttagcaaccatctcaaacatagggtcagatgcaaacttaattttcttataccatgcttcttccttttaaaagaattgttttgatttctgagttacaaatccaagataactataacatagcttttttgccatatttatttttttaataattttttttctgatcacgaaatgaatatatgattattttaaggaacttggaaaacaaaatgacaaaaaagaaaattaaaaattctacctagacatagccattgttaataacttgctatatttttccttctagtgtagacctatgtaaagtatacatttactttataattaaaatttgtcattttatatcacaattttacttaaaattctattgtggcatttcccatgtcattggatattgtttgaaaacatcatctaaggccaggagcggtggttcacgcctgtaatcccagcactttgggaggccaaggcgggcggatcacgaggtcagaagatcgagaccatcctggttaacatggtgaaaccctgtctctactaaaaaaaaaaaatacaaaaaaattagctgggcttggtggtgggcgcctgtagtcccagctactcaggaggctgaggcaggagaatggcgtgaacccgggaggcggagcttgcagtgagccaagatggcgccactgcacttcagcctgggctacagagcgagactccgtctcaaaaaaaaaaaaaaaaaaagtgtaaacagctggataacatttctttttgtaaatataaatatagtttaatcattctcccattggaggacattttgggtattaaaatgatactggagtacaaaatcttggtgcataaatttcatctgagtttgtttctttgggatagatttctagaagccagtaactattcatggaattagattggatagctgataaaagcagggcatcaagggagaaaaaagagttgagagagcaaaacaacatgcttaaggatcatgagattcgtgaattcagcttctgtcatatttgaattgagtggcaaatttgtctcttacctgaatttggagacccttctctaattagggatgattattagagggaaattctgccctactgtggacaccagagagttggttgtgtgttgtagtgttcaagagttttatccaatattctgcttcctgcagagttcctgaattgagggtcttttgtggaatatctcattgaagtagacttttaaccttgacttgctcaacatctgatcagaagcagctcgttgtcatataaggaaatctgctctgttatggaacatctttgagtagttgagttcccctttttcccataagtccaaatttgattccctgtcaccttcaattgttctttaacttgtttttaaacaaaagtctccctaaaaataattccagaagtatttgaactttatttctctattagcttctactgtaattaacatgaaaacaaacatgttttaaagtctttgtttccttctaaggtataatttagctttatcacgtcttcatagtgaaagttgtatacgtgaacgttggtaggatagaaaaactttccacatagttttatacttggtgcccagaaaacttccaaagtgtttaggtactactcattattatttcttagaaattgaatagaagcagtggcttgagtatacacagtcccactttttcgttaataataaccacatttccctttttttttttgcacaaaagtgttacatgtattttctcgtttaatccttgtacaacctattagggtaggtattttcctcatttggcagatgagggtgctgaggctcagagagatgaaagacctttcctgtcacacagctattaagggcagagctaggatttaaactcagatctaattctaaaacctgtatatttaactagtttgcacatctgtctccctgacttaattgcatcataaaatcaaagatatttctcttcaaaatatgttcatgttggattatttggctgtttcactgttagaggtctgttgcttctgctggcttttctgtggcaatcccagctgctcttccccgtggcttgggcacaccaaggatttcctttctgtgattgccccatatctccctagtccgctgtggggggcaccttcctgcttctgaggaaactgaagcaggagatgaggaaagggtaacaattaattacatacttttttttcccgagtattatcaactaacatgttccataaaggagcatgttttcacagctgtgtgctttagaaacagggagaaaggtttgagtttttatgactgaggtatcttcaacaaaggctgtgatgtacacgcttgatggacttggaacgtggaaacccattccctccctcagccctgggattggaatctttgtgtttatggtcacatgagtattcagatatgttatctctgaatgtgatgccctggtcagagaaccaaggagtggacttgctagattatatgatttaattaccctagatcaatcaagctttgacttactgatggcaggatatattgtgtattttttcctagttgctagaggaaaggaacaaagtttaatccttggctttgttgacctttggtatcacttttatcttgtagttccgtataactgcctttgtagactcttcaaaaggctgaaggcaagtgatttatagataagggctcattcagtacttgcacaagaagagcccatatcttcaaatatgggtgacgtaaatttacttcagaaacagaaatgagctcatttatttggagagatgtgaacagaatgtgcgtcttttgctccgggtgagaaataaatttaaattcagaactttgcttgggggaaatgaaatggaggaactaggcacttgagcctcttggaaattagagatctttagccaaggcccaagggagcactgtcttggtccatttataacaaaatactggagactgggtaatttataaagaacagaaatttatttctcactgttctggaggctgggaagttcaagattaaggtttgttgagtgctgcgtcttctagagtggatgaacactctgccctcaactggcagaaggagaatgggcaaaaaacaggagtaactcccctgctgagcccttttgtaagggcagctaatcccatttacccagagaggagccctcatggcctaaccacctcttaaaagccccacctcctattactgtcattggcaacacctgcattttggaagggacccattcaaaccatagcaagcaccaatagtatgtttcagaactcatccacataggagcactcctcagcatgtccaacagcagtctgtggagaactacttttttgttttggtttggttttttgttttcttttttgtgacacagtctctgttgcccaggctggaatgcagtggcatcatctcagcccactgaaatctctgcctcctgggttcaagtgattctcctgcctcagcctcccaagtagctgggattacaggtgcccgccaccacacctggctaatttttttgtatttttattacagatgggctttcaccatgttggccaggctggtctcaaactcctggcctcaagtgatccacccacctcggcctcctaaagtgctggcattacaggcatgagccaccgcgcccggccagagaactactttgtgtaagtctacgaggcaccatacacactttttcccttaaggaccttactgagtaactgggaagagagagcaggaatgtcaacaataatacagaagaagggttctatggtaaatgccgaaagtgaaccttcaacgaagtgagttccagagagacaacccataaaggtaaagatttagtcataaatgagctgtgttgctactgaaaacatcttgattctaaagtataaccacatctcaaccaagcaaaaactgtcttaagcctgaattaagaggaaaatgatattttaaatgaactcctcaagtaagttgccaaatcattgacactagaattttaagaattggtgactctagagctttcatggtttggctactgtattatctccctcaaggtgcagtaatatttctgtcaccaaaaatcattaattgataacattattctttctgttagttctagcacttatttccatcactgtgatttttttattatgatgattatttttactttacttacttagtataggggattacctgccttttaatgtcatcctgacaattaagacaaaatacagaacatgcttagcacagtgcttggctgagagagtgccatcattaatattaggcattatttttcttattcttgaaatacagtgttttatatagtgcctggcatgtagttaaattttagtaaattataataatgttgtttattgttttccaaaggatttttaacatgtattatcaattaatactctgagctacattcaaggtatatagtgctattcctcttttactaatacagaaactgaagttaagtacattggtcagatttttctggctgatttaagcagataaagaaattattaaaaggaatgtggatagctcacagaatcagcagaagagctctagaatcgtgttttgggctacctagccaagtaaaatggccaagatcatgccacagaactgagccactgccaagtacctgccgtgccttgcacggcaaacaatgctggctggcattggtgaccggactttgccacagggattgcttctactgctcccttggaaactgttttacagaaactgctgtcaccaaggaatgtacttcatggaaggccctattttgcaacatttgccccctatttacagtctggagtgggtggcaatttgctttattgccaactcattgtgtcttaactctctgtgaaagaaatacttcgtttatattttcttttaattggatataaactgagtagaagttgagattattttccttattagtagacttcgtgtgtggaaaagttagttttttctgaaattgatcttgttcttagcaattatctgctataagtattgcctcaactttttaggctactactaaatgagaactttccatctgatcagggcgtcttctccagtgtaaacaatcctgtttcccattacccattggagctaaggaacccatgatgagttaacacgtgcaagaagggttacccctttgagcaagaaaagtcctggcattagtatttcagatttttttcttgcatccttttctgatattttatttattttcatttaaagtggacctatggtttatcttgctgaaaatctcaaaaaaccaaaaaacaaacaaacaaaaaaaaaacgtgtcaggtccctaatgtgattgctgttaaccatataaaaataacctcccctcttttataatcagtcttggtgcgccttgcaaagcctacatttctaacctgtgtatacttcaaactactgtgagcatgtgttaaacacctttttttttttaaataaaaagaacactttcagctccttaaagcaagctcttttgggaaggaaagaatccctgagtgctgcagccatccatcctgctttgtctggaaagctaaggtttttgggttattgatgtttcaacaagtggagagcacctaggtctggtgagcaccagctgctgaagtgtggggggcacccaagtggcctgttcttccaggatggcattcattcttccaggcaagtgggacaaagtgggctttctgccttcactcagtgagagctgttgaaagattttctcatctgaattgtgaatgtttgtaatgtttattttcacagtaagagtgagggccttctcactttgaatatattcctttttgcaaataattttgaagtagtcctgatcctgtgttaaaagaaacatggtatgtcattatagaagaatccttcatcccccttcccttacaaacataaaattttcagagtttacatttggaagaaaacctggttcaattctctccattttcagggaaggaaatggaatttattctttcctttgtttatccttttatagttttcattttgttccctgttggtcacatttttttttttggccttcttattagaggggtattgtggaatatttttgcttagcaaaaattaaaatcaacatacctgactttgtaattgtaaaatatgtataacatacaatttatcattttaatcctttttgagtgtacaattcagtggcattaagtatattcacattgttgtgcagtatcatgaccttccatctccggaacttctccgttatcccaaattgaagtctattaaatagtaatttcccaatctctaccctcagccctgacaaacattattattctacttattttcgccatgaattttactattctttttgtttttttttttttttgagacagggcctcacgctgtcacccaggctagagtgcagtggcacgatcttggctcactgcgacctccctctaccttacaggctcaagtgatcctcccgcctcagcctcctgagtagctgggacctcaggtgcacaccaccacgcctggctaatttttgtatattttgtagagacggggtttcaccatgttgcccaggctggtctcaaactcctaggctcaagggatccttccacctcggcctcccaaatgctggggttacaggtgtgagccaccgcgcctggccaaatattactattctgtatgtttcttgtaaattgaatcatacagtttttgtccttttgtgtctggcatacttcagtttaccacaattttttcaggttccatctgtattctagcatgtaccagaatttcattctcttttttaaggctgaattctattatgtgtatataccacattttgtttatcctttcatccattgatggacatttgggttgtttctactttggccattgtgaataatgctgctgtgaacattgatacataaatatctgtatgagtccctgctttcagttcttttgggtgcatacccagaggtggaattgctgggtcatgtggtaattctatgtttattttttttcctcccttgtaattacccacaatgtggtaaaatacacttgacatgaaatttaccactgtaactatttttaagtataagttcagtggtattaagtacattgagattgttgtgtgaccatcaccactgtccatttcctgaatgtttttcatcttgcaaacctgaaactctatatccgttaaacagcaacttcctatcctctcttcctcccagccctggtaaccactgttctactttctttctctatgattttgacttttctgtgtacttcatataaatggaatcattcagtgtttgcttgtgactggcttacttcacttagtgtaatgtcctcaagattcacccatgttgttgcataggtcagaattttcttttaaaggctgaataccacatgtgtatatatatagaaaaatattattcagtcttaaaagggaattcctttttaaggaatgcctcattttgcttatccattcttctattgatggaaatttgaattgtttccatgttttggctattgtaaatcatgttctttgaaaatgagtgtacaaatgtctctttgagaccctgcttttgattcttttgggtatatactcagaagtggaattgctggatcatatagtaattttacatttaattttttgaggaaccaccacacccctttcgccagcggctatgctataccatgttacgtctccaccaatagtgagtaagggttctacatctttgccatcatttttttttgtttgtttttgatactagccatcttaatgggtgtgagggggcatctcattttagttttgaattgcccttccctaatgattagggatgtcaggaattctttttatctatttatttattttttattttattattattatactttaagttttagggtacatgtgcacaacgtgcaggtttgttacatatgtatacatgtgccatgttggtgtgctgtacccattaactcgtcatttagcattaggtatatctccaaatgctatccctccctcctccccccaccccacaacagtccccggtgtgtgatgtttcccttcctgtgtccatgaacacatggacacttattgttcaattcccacctgtgagtgagaacatatggtgtttggttttttgtccttgcaatagtttgctgagaatgatggtttccagcttcatccatgtccctacaaaggacatgaactcatcattttttatggctgcatagtattccatggtatatatgtgccacattttcttaatccagtctatcattgttggacatttgggttggttccaagtctttgctattgtgaatagtgctgcaataaacatacgtgttcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaccctctccagcacctgttgtttcctgactttttaatgattgccattctaactggtgtgagatggtatctcattgtggttttgattttcatttctctgatggccagtgatgatgagcattttttcatgtgttttttggctgcataaatgtcttcttttgagaagtgtctgttcatatccttcacccactttttgatggggttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacattgaagtctttaatccatcttgaattagtttttgtataaggtgtaaggaagggatccagtttcagctttctacatatggctagctagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagtatgatgcctccagctttgttcttttggcttaggattgacttggcaacacgggctcttttttggttccatatgaactttcaagtagttttttccaattctgtgaagaaagtcattggtagcttgatggggatggcattgaatctataaattaccttgggcagtatggccattttcatgatactgattcttcctacccatgagcatggaatgttcttccatttgtttgtgtgttcttttattttattgagcagtggtttgtacttctccttgaagaggtccttcacatccctttaagttggatccctaggtattttattctctttgaaggaattgtgaatgggagttcattcatgatttagctctgtttgtctgttattggtgtataggaatgcttatgatttttgcacatggattttgtaccctgagactttgctgaagttgcttatcagcttaaggaggttttgggctgagaccatggggttttctagatatacaatcatgtcatctgcaaacagggacaatttgacttcctcttttcctaactgaatgcccttgatttccttctcctgcctgattgccctggccggaacttccaacactatgttgaataggagtggtgagagagggcatccctgtcttgtgcccgttttcaaagggaatgcttccagtttttgtccattccgtatcacattggttctttcatgtgcttattggccatttgtatctcttatttggagaaatgtcggttcaagtcctttgcccatttatgaattgggttgtttgaggttttttgttgggttttaggaattctctatatattctggatataatatacatgtatataataaatgtatataataaaatatacatgatttgaaagtattttctgcattttgtgggctgcctttttactctgttgatagtatcttttcatgcataaagttttaaaattttcattgtccaatctatctttttttgttgttgccagtgcctttggtgtcatacttaaaacattgttgcccaattcagtgtcatgaaacttttgcctgcgttttctcactataggaaactatagtaaaaaacattaaacgttttattgttttagatcttacatttaggtcatggattcattgttaattaacttttgtatatggtagtaggtaagggtccaacctcattcttttgcatgtggatagccagctttcctagcagcatttgttgaaaaaactgtcctttcccaactgaatggtcttggtgcccccaacaatcatatgactttatatgtgagggtttgttctgggccctctgctcatttctgtggtccatttgtctgtctttatgtcaatgctgcactgttttgattactgtaattttaagttttgaaatcaggaagagtgagtcctccagctttgttcttcttttcaggattgttttggctattcaggatctcttgagattccatatgaatttttggatggatctttctatttctgaaaaaaagtcactgggattttgatagggattgcattgaacctgtaaatcacttttggtaatattgacatcttaatattaaatcttccaatcaatgactatggggtgtcttaacatttgtatgtgtcctctttaattcctttcagctgtattttatggttttttttattgtacaagtctttcatctccttggttaagtttattcctaagtgttttattctttttgatgctattggaaatggaattgttttcttaatttcctttttggattgttcattagtgaatagaaatgcaactgatttttgcatgttgactttgtatcctgccactttggtgaatttatttatttattagttctgatagtatttttgtggaacattcaggttttctatatatgagatcatatcatccgtgaacagacataatttaacttctttctttctaatttcgatgccttttatttcttctcttgtcttattgctcttgacagaacttccattattatgttgaatagaagtggtgaaaacaggcatccttgctttattcctgatcttagagggaaagctttcaggtcatcaccattgaatatgaagtttgcttgcatttcttttatatggcttttattatgttgaggtagtctccttccattccttgtttgttgagtgttttatttgtttgtttttatcaagaaagggtgttgaattttctcaaatgctttctctgcatcagttgaaatgattttgtggttttctttttttttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattggggattggtgatgactctttttttttttttttttttattgatcattcttgggtgtttctcgcagagggggatttggcagggtcataggacaatagtggagggaaggtctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacctccatccacacagacccggcaaccatctgatttctcagttttttccccacccttcctgcctttctattccacaaaaccgccattgtcatcatggcccatccccaatgagccgctgggcacacctcccagacgggtcgtggccgggcagaggggctcctcacttcccagtaggggcggccgggcagaagcgcccctcacctcccggatggggcggctggccgggcggggggctgacccccccaccatcctcccggacggggcggctggccaggcagaggggctcctcacttcccagtaggggcggccgggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggccgggcagaggggtcctcacttcccagtaggggcggccgggcagaggcccccctcacctcctggacggggcggctggccaggcggggggctgatccccccacatccctcccggacggggcggctggccgggcggggggctgaccccccccacctccctcctggacggggcggctggccgggcggggggctgacccccccacctccctcccggatggggcggctggccaggcggggggctgacccccccacctccctcccggacggggcggctggccgggcagaggggctcctcacttcccagtaggggcggccaggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggctgggcagaggggctcctcacttcccagtaggggcggccgggcagaggagcccctcacctcccagactgggcggctggccgggcggggggctgacccccccacctccctcctggacggggcgactggctgggcagaggggctcctcacttcccagtaggggcggccgggcagaggagcccctcacctcccggacggggcggctggccgggcggggggctgaccccccccacctccctcccggatggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgtggccagcagaggcgctcctcacatcccagacagggcggcggggcagaggtgctccccacatctcagacgatgggcggccgggcagagacgctcctcacttcctagatgggatgggggtggggaagaggcgctcctcgcttcctagatgggatggcggccgggcggagacgctcctcactttccagactgggcagccaggcagagaggctcctcatatcccagacgatggggggccaggcagagacgctcctcacttcccagacggggtggcggctgggcagaggctgcaatctcggcactttgggggtccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcggcgtgcgcctgcaatcgcaggcactcggcaggctgaggcaggagaatcaggcagggaggttgcagtgagccgagatggcagcagtactgtccagctttggctcggcatcagagggagaccgtggaaggagaccgtggagagagggggagggggagggggaggggcgattttgtggttttcttccctttagtcttctaatataggctgttacgtggattgattttcgtgtgttgaatcatccttgtgttccaggaataaatctcacttggtcatggtgtataatccttttatatgctcctgaatttggtttactaggattttgtttgggatttttgcatcaatgtttgtaaggtaaattggtctacagttttcttttcttgtagtgtttttgtcttgctttggaatcagggtaatgctgccctcatagatgagttagggagtgttttctctgcttcaattttttgggaaagtctaaaaagggtttatgttagttcttttaaatggttggtggaactcacctgtgaaactatcagttccagggcttttctttatcaggagatttttttattatgtattcaatctccttactaattataggtctattcagagtttctatgtggcttagccttggtaggttctagttctgtgtttctaggaatttgtccatttcacctaggttatctaatttattgctgtacaattactcatagtaccttgtaaagtcatttttattcccatagaatcggtattaatgtacacactttctcgttttagtatttgagttgtctctcttttttcttagttcctctactctagcaaaaggtttgtcaattttgtttatctttttaaagaatcaacttttggtgctggtgattttctctatttttttttctattctctattttatttatctttggtctaatctttcttatttctatccttctgctaactttgggtttagtttgtttttctagttccttaagttgtaaagttagattgctggtgtgagatctttctttttattttttattttattttattttttagagatgggtatcactctgttgccaaggctagagtgcagtggtgcaatcatagctcattgtagcctcgaactcctggactcaagtgattcttctacctcagcctcccagtaactgagactacagacacacaccattatgcctggctaatttttaatttttatttatttacttatttttttaaagagacagagtctcactaggttgcccaagctcttctcgaactcctgggctcaagcgatccttccacctccgcctactgagtagatgggattatagatttgagtcaccgcacccaactcttgttttttaatgtaaacttttttttttttttttttttgagatggagtcttgctttgttgcccaggctggagtgcagtggcacagtctcagctcactgcagcctctgcctctcgggttcaagcaattctcctgcctcagcctccagagcagctgggattacaggcaggcgccaccatgcctggctactttttgtattttttttttttttagtagaggtggtgtttcaccatgttggccaggctggtcttgaacacttgacctcaagtgatccacccgccttggcctcccaaagtgctgggattacaggtgtgagtcatcctgcccagcctaatgtaaacattgataaatttcccccttagcattgctttcactgcatttcataagttttggtatattgtgtttttgttttaattcacctttaggtttttttcagtgtcctttgtgttttcttcattgatctgttggttgttttagtatgttctttaccgtccacaaattgtggattttccagtttttcttctgttgtagatttctaacttcattctattgtggtggaagaagattctttgtataatatctatcttttgaaatcttttgagacttaatctgtgacctaacatatggcctatcctgaaaaatgtcccatgtacacttgagaagaatgtgtattctgttgttaggtacattattctgtctgtctgtgaagttgagtcagtttgttgtgtgttcaagtcctctactttattacttatcttctgtttggtggttctagtcattattgtgagtgggatattgagacttccagctattattgaagtatttttcccttcaattttgtcagtgtttgcttgacaaattttgatggtctctcattaggtgtataaatgtttataatttttaaatctttttttgagacagggtctaactctgtcacccaggctgcagtgcagtagcgagatcttggctcactgcaacctctgcctcctcattgatcctccatctcagcctcctgagtaggtaggactagtaccatcatacccagttaatttttatatttttagtagagatggggtttcaccatgttggctgggctggtctcgaactcctgagctcaagcagtccacctgccttagcctctcacagtgctgggagtacaggcatgagccaccacacttgatttgaatatttataattctttttttttatcttcttgctatatcaaaccatttatttatttatttatttatttatttatttatttatttatttatttatttttgagacggagcctcactctgtcgcccaggctggagtgcagtgacgcaatctcagctcactgcaaggtctgcctcccaggttcacaccattttcctgcctcagcttcctgagtagctgggactataggtgcctgccgccatgcctggctaattttttttttgtttttttttttgtttttttagtggagatggggtttcactgtgttgccaggatggtctcaatctcctgacctcgtgatctgcccaccttggcctcccaaagtgctgagattacaggcgtgagccaccacacccggcctgaaccttttattaatatatgatgtcctttgtctcttgtaaccgctttcagtttaaggtctattttggtcagctacagtaactcactcctataatcccagcactttgagaggctgagacaggaggatcacttgaggcagaagtttgagactagcctgggcaacatagttagacccccatctctacaaaaaaatttaaaaattagccaggtgtgatagcgcatgtctgtagtcccagctacttgggagtctaaggcaggaggattgtttgagcccaggaattcgaagatacagtgagctatcatcatgccattgcactacagcctgggtaacagcgtgagactctctttcagtatagctcttttggttactatttggatgaatatctttttcatccattttcagcctgtttgtgtatttagatgtaaattgagtctctagtagacaagcatatagttggatcaggtttttaatccattctgtcaatccctgtcttttgattggagagtttaatccatatacatttaaagtacttaactgatacagtggcacttacttctgtcattttgctattagttttctagatgccttatagcttttttttgtttgtcattttctgtattgctgtcgtcttctgtgttgattttttgcagtgaaacatttatattcctttctcattcccttttgtgtatgttatatagctgttttctttttttaaaattattatactttaagttctagggtacatgtgcacaaagtgtaggtttgataaataggtatatatgtgccatgttggtttgctgcacccaccaactcgtcatttacattagatatttctcctaatgctatccctccgccagctcctcactccctgacaggccccggtgtatgatgttccccgccctgtgtccaagtgatctcattgttcagttcctacctatgagtgagaacatgcagtgtttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctgttgtgaatagtgccataataaacatatgtgtgcatgtgtctttatagcagcatgatttataatcctttgggtatatacccagtaatgggatggctgggtcaaatgttatttctagttctagatccttgaggaattgccacattgtcttccacaatggttggactaaattacactcccaccaacggtgtaaaagtgttcctgtttctccgcatcctctccagcacatgttgtttcatgactttttaatgattgccattctaattggcatgagatggtatctcattgtggttttgattcgcatttctctgatgaccagtgatgatgagcattttttcatgtgttttttggcagcttagatgtcttcttttgaggagtgtctgttcatatcttttgcccacttgttgatggggttgtttgtttttttcttgtaaatttgtttgaattctttgtagattttggacattagctctttgtctgatggatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccattttgaattaatttttgtataaggtgtaaggaagggatccagtttcagctttctacatatggctagccagttttcccagcactatttattaaatagggaatcctttccccatttcttgtttttatcaggtttgtcaaaaatcagatggttgtagatgtgtggtgttatttctgagggctctgttctgttccattggtctatatctctgttttggtaccagtaccatgctgttttggttactgtagccttgtagtatagttgaagtcaggtagtatgatgcctccagctttgttctttttgcttaggattgtcttggcaatgcgggctcttttttggttccatatgaactttcaagtagttttttccaattctgtgaagaaagtcattggtagcttaatggggatggcattgaatctataaattactttgggcagtatggccattttcatgatattgattctttgtatccgtgagcatggaatattcttccatttgtttgtgtcctcttttatctcgttatttcatcgagcagtggtttatagctctccttgaagaggtacttcacatcccttgtaagttggatccctaggtattttattctctttgaagcaattgtgaatgggagttcactcataatttggctgtttgtctgttattggtgtataggaatgattgtgatttttgcacactgattttgtatcctgagactttgctgaagttgcttatcagcttaaggagatttggggctgagatgatggagttttctaaatatacaatcatgtcatctgcaaacagggacaatttgacttcctcatttcctaattgaatatcctttatttctttttcttgcctgattgccctggccagaacttccaacactgtgttgaataggagtggtgagagggagcattcttgtcttgtgccgattttcaaagggaatgcttccagtttttgcccattcggtatgatactggctgtgggtttgtcattaatagctcttattattttgagatacgttccatcaatacccagtttattgagagtttttagcatgaagcgctgttgaattttgttgaaggccttttctgcatctattgagataatcatgtgttttttgtggtcggttctgtttatgtgatggattacgtttattgatttgtgtatgttgaaccagccttgcatcccagggatgaagccgacttgatcgtggtaggtaagctttttgatgtgctcctggattcggtttgccagtattttattgaggattttcgcatcgatgttcatcagggatattggtctaaaattctcttctttttgttatgtctctgccaggctttggtatcaggatgctgctggcctcataaaatgagttagggaggattccctctttttctattgattggaatagtttcagaaggaatggtaccagctcctctttgtacctctggtagaatttggctgtgaatccttctggttctggactttttttggttggtaggctattaattattgcctcaatttcagagcctattattggtgtattaagagattcatcttcttcctggtttagtcttgggagggggtatgtgtccaggaatttatccatttcttctagattttctagtttatttgtgtagaagtgtttatagtgttctctgatgatagtttgtatttctgtgggatcggtgatgatattccctttatcatttgttattgtgtctatttgattcttctctcttttcttctttgttagtcttgctagtggtttatcaattttgttgatcttttcaaaaaaccagctcctggactcattgattttttttaagggtttttatgtctctgtctctttcagttctgctctgatcttagttatttcttgccttctgctagcttttgaatttgtttgttcttgcttcttttaattgtgatattagggtgtcgattttagatctttcctgctttctcttgtgggcatttagtgcttatgctgttttctttgcacttatcatgaggattatatttaagatcctaacgtggtaacacaataatttgaatttataccagcttagctttcttttcttttatttttttttttaagtgaaaacaagtttattaagaaagtgaaggaggccggatgcggtggctcacgcatgtaactccagcactttggaaggcccaggcaggcagatcacctgaggtcaggcgttcaagaccagcctgaccaacatggtgaaaccccatctctactaaaaattcaaaaattagccaggcgtggtggcacatgcctgtagtctcagctacttggaagaatcgtttgaacccaggaggcagaggttgcagtgagccgagatcgtggcactgcactccagcctgggtaacagagtgagtcttcatctcaaaagaaaaaaaaaaagtaaaagaataaggaatgacctccagaggcagagcagtgacagcttaactttcataacatagaaaaactctgctcctttccagcttagtttccatccctttcagttgttaatgtcacaagataatatctttatacagggtgtgtccaaaatataaactaatacttttttaatgcagtaatctctcaaattatgtaaaaaaacaaaatatggagttataaactaaagttacaataacattagcttttagactaattttttttaatgtatcagtctcttaacgcagaaagccaaaagtggagctacaaaccatggttacaaaagagttacgaaccatggttacaaaaacccctgtaaatacatgggcttttttttttttattttttatttatttttttattttttgagatggagtctcactctgtcacctaggctggagtgcagtggcgtgatctcgactcactgcaagctccgcctcccggcttcacgccattctcctgcctcagcctcccaagtagctgggactaaaggcgcccgccaccacgcctggctaatttttttgtatttttagtagagacggggtcccaccgtgttagccaggatggtctcaatctcctgacctcgtgatccaccctccttggcatcccaaagtgctgggattacaggcatgaacagtacatgggcttttataatttgccatatatttacctttactgagatctttatttcttcactcaactctctagtgtgctttcatttcaacctgcaggaccccctttagcatttcttgcagggcaggtctagtattaagaaactccctcagcttttttttttttttttttttttttttttcctgactgatacgcttaatttctccctcatttttgaaggatagttttactggatataaaattcttggttgacaggttttttgttttttgtttttttttcttttagcagtttaccaccttatggccccctaggtttctgatgagaaatctgttgataatcttattaaggttcccttttatgtgataaggtgtttttcttttgctgctttcaaatttctcgttgtctttttgtttgttttttgagacagagtctcagtctgtcacccaggctagagtgcagtagtgcaatctcagctcactgcaacctctgcatcccaggctcagatgatcctcctgccttagcctcccaagtagctgggactacaggcatctgccaccacgcctggctaatttttatatttttttgtagagatggggttttgccatgttgcccaggctggtgtcaaactcctgacctcaagtgatctgcccaccttggcctcccaaagtgctgggattacaggcgtgagccagtgtgcctggccctttctaaaggttgattataatgtgtcctggtgtgggtctctgaatcctgttttgagtttgttgagcttcttggatgtttgtattcatctctttcatcaaatttgggatgtttttggccattgtttcttcagatgttttctctccctttctctttctgttttccttttgggactcccacaatgcatacggttatccacttgatggtgtctcatcaatcccttagatcagttcacttttccttaatcttttttctttctgttcctcagactagatagtattcattgtactcattattcactcattctttcttctgcctgctcaaatctgcctttgaatccctgcattgaatttttcgtatcagttatttcagttccagaacttatttttcatttctttttaggttttctgtctctttattgatattttccatttgtttatacattgttttcttggctttctccatgtctcctttagctctttgagcatctttaagacagttgttttaaagtctttgtctagtggatttgccattgtcttttttcagggacagtatctgttggtttatatttttcctttgaatgagccatacttttctgtttctttgtatgactggtgatttttttttttttgaaaattggacatttaaatccagtaatatggtaactgtggaaacagattctcccccttctctgggtttactgttttttgggtttatttttggtattttgattgttacaggatgtgtctgtgccaagaatcagccagaggtatacatgttaggtctcctcagatcttttctgagcctgtgctcttccctgggcatgcatagcaactttctaatttcccctatatatgtggttgcttttgaatatcctggtctttaatgtccgggtcccagagagggaaaaagaaaaaagtgaaggagggtgaaaaaaatgctgccccctttaatcctctgaaagtcacttcagcgtgagtgggaagaccttgcagcagtgtggtggaggtgcaacaacagtgattaccgtctgtgtctctgtctgcacctttgtgatcagaagcagccaacattgatcagagcatagattcatatttagaggacagggtccttttctcccctgctgtctcccacaaactgtgtgcaagccactccaggaataagtgcgtagctgcctgcagtggggatgggagctttgagatggctggtgctattatgatgacagctgaaatagactgaaagtaattataattcatcatccaggccttcctctggatgttgcaagccttcaatagactctagagctacaaaatagttacatcagacagagtgcaccagtgcaattatttagttgggaagataaattcctggtgcttcctaccacagtcttccccaaattccctttttagttactttttttaggaacccccatactgttttccccagcaggtgcaccattttacattgtcaccagcaatgcacaagggttccaaggatatggagaacatccttgccaacacttgttattttccattgtttggataatagccatcctaatgattaagtggtatctcattgtgttttgtatttccctcatgattagtgatgtcgagcatccttcatatgcttattggctgtttgtatatctcctttggagaaatgcctatttaaatcctttgcccaattgtgtggtttgttgttttatctttttaaatttagctccttttcatatttgccttccttataaataactcctgcttcttctggtaatctgcttgaggaatgagatcatttctttgctatttcctacagtgctagtacatagtagtgtgtgcctggtaaacacttatagtggtaggataggccagtcatacagccagcttttgaaagcctgcttaattgactactacagttggtgactggggactttgagacagtgaggaaattaacacgaattgtgtgcctcctctttgctaggtgctgtggtaggcataactttatatagttcccataatactcctttaatatgtcacacttacagatgaaggatttgaattaagggaagttaaatttagactccctcaacatcacacaggttttaaatggcaatccttggattccaattccgggtctacctgactccaaactttttcattataccatgtggtctcccttccctagtctggtaagttcaaacagagagcaagcctgcgaacctggaaattgtttagggcagatgagcagttgaacatttacttaataggagacagagaatcgtgctatattgccgaggctggctttgaacttctaggcttaagcagtcctctcacctctgcataccaagtagttggtaactacagcctattccattttacttaattattcaagaggaaaaggtagagattgtgaaatgctaattttatagcagtgaacaggattcctcgaagacactgaggtgtgtcgtttgtggatactgatgacctttggaaatactgtgtctacttttgggtgtgacatcctctgttcttgtttctttggtaccataaattagggccactggccatggccaaatgggtgcctaacacagaaggatgaagtgcttttcattgcttaccacaaattcccttgaaccctttacttctctgagacttaagaaatgcaagaataaagggaacagagttttatcaaaatcctattgtgtgctaggcaaaccctagaagggacatgattattatcttgcttttacatatgagaaaattgaggctcaaagatgtaagataaattgtccagattcacacagctaataaataagggagctgaattcagctttttccatgctgcctccattaaaaagttcctctgtcttgccctctggtgggtttcggaggtcctgggagaaatgtttgtatcctcaccaaacattgtggtgggtggcatcttacatggggcttgttctgcacttgcagtttcttctgccacatggtttaaccagagcaatgatgactgccgttgccccctcgaggttagcactcctctgaggtcacagggtggggataaatgttctgaaggaatcagccttagaaagcacactttttctaagtatcccgaaggaatcaatcactaacgcacatcacaaaattctctccaagttgggaagatggttttagactttctctttcttttctttttttttttttttttttttttttgaggtgggagtctcgcactctcgtccaggctggagtttggtggcacaatctcggctcactgcaagctccaccttccaggttcacgcctttcttctgcctcagcctcccaagtagctgggactacaggcacccgccaccacgcccagctaattttttgtatttttactagagatggggtttcaccgtgttagccaggatggtctcgatatcctgaccttgtgatgggcccgcctcggcctcccaaagtgctgggattacaggcgtgagccaccgcgcccggccagactttccctttctttaagaagagaagggagtgcctttgagaactagagtttaagtaaaggatacatatagcttaagtgcttttatctttgaaatatactatgaccaatagactcgaaaatttcttattgtttttgggggtatcatagtcaatttgggctcctataacagaataccataaaccgggtggcttaaacagcaagcatttatctctgatagttctggtggctgggaaatccaaggtcaaggtgccggcagatttgcctctgccgaggacctgctccctggtttgcagatggctatcttcttgctgtggcctcacatggctgggaacagaaagagtgaggggaggctctcacatctcttcttctagtgacactagtcccattcatgaagcctctatactcatgatctactcacccactaaggtccccacctcctaataccattacactggggattaggatttcaacataggaaatttggggaaacacaaacattcagtccatacgggggaattttcttttttcagaatctgttgtttaattataccttcacagtaacttttgtcaaagttatatttaatttctacttcctggattctgtagcagtaaatggagctcgttatgtgtcccaatatttgtaatactgatttctagtcctagaagtatctaagcctctcagagttaaggaattcggtttggtaataggctaagctaatagccatatggctctgcactgtgctatagagaaactgtgggtttccccccacctgacatctcagaatgaaaaagatcactctgcagaatatttcccacacttctaaccctgatgatttttccactcaacattttacacaaagaggtaggtacagatggtagtttgctggatctctggaatattcagtcttggtcttcactcactccctggagcctactcctcatttttgtataagcaaagtggtttaaacagggtcttaggaaatatctccagtatttaccatttgcaaacctaacccttaatatatggaatctgttagatcaggtttttaactcagtaaacatctttgggtgcatccccgtattaaactaaagaagaagtagaaaactgaaggcaatggccctgttgcttaactgtaaggaacatgtaatttagaaacttcttctctttaacatggaaaactaaccataagtatgtggatcaacgttcttctttatggagtattaggagtgaagtgtcatgatgttatggtgtttttaacggctcagcaaaagaaaaaaaattatatagtgagatgaagtagatatgacaaaatattagttgttgaatctaggtggtgggtatttgggtatacatttttcccctacttttctacatttaaaaattttcataataaagggtaaagcagaaaaatcctaagtgtaaaaaacatttataaaactatacaaaaaataatttcaaggttcattctctattaatggtattggagttggtaggaaataattaaaataggagtataaatccagaagcccgcagaggccaggcaggtaatgtgggtgagtggagctgccgggcattggacaggagggagatggtggggactgagcaaacaggcaagtgcacaactcattgaaagcattccaaaaatttaaaaaatcttaatgctcattcagaatgaaacacttcagaggactggaagtttgtggtctcctaaaaatgacaaaatttaccgtctctaaatttgcccagctttctgtccttctccctcttttcagaagatccaggagaggcgtagctatcaatacgagagggagatggtttcctggcacaagagggtgatgggaaaacattgtgttcaatgcctctagaatttgcctgggttgccacaactttgttgcttcaggaatggaaaatgtggcccatcttcttattttctctgtcctgtcttgctcctgctatgacccggggcaggatttgcggtgggtttatggagattcctatgagtcaaggaagcacattctgaggatagagtcatgcacctgggttttgtttttagatggttagagggaggctgcaattgtgatttataagaatgacttaaagtgtaattcctttgattttgaagttggctaggcaacttaatttgaacatcctagtgtgcctattagacctggcaaccttctcaaaatccccctcctacttccctcgtttccctcaccctccacctttttctcaagaggtagaagtgagagttttgttttgtgagctaaggttgggttctgggccctctgcttcagccacctggcagcttgggctggccctgtagccttcctccacttcattctgcgattcaggctcccaatagtcttctgaagcaccggagagcttcctcatgcaccttagaagagcagattcagactgagacaaggactcgctcttaggcatatatgcagcctacagagatcctgggaagcctttttcctcctaatatcttcctagacttatgctttccttggaattccagcaatagaactgcatactcgtaccctaatcaagaaccttttatgtactaggtgctctactagacatgagataaaaagataagcaaaacgtggtccctgtcttcaaccagctcaccatttgttataccactttaatcaccttagagaaaatttttttttttttttttgagacagagtcttgctctgtcacccaggctggagtgcagtggcaagatctcggctcactgcaagctctgcctcctgggttcacgccattctcctgcctcagcctcccgagtagctgggactacaggcgcctgccaccacgcctggctaatttttttatatttttagtagagacggggtttcaccatgttagccagggtggtctcgatctcctgacctcgtgattcgcctgccttggcctcccaaagtgctgggattacaggcgtgagccactgtgcctggccgataaaatgttttaagatgtgttcggccatatgaactttggtgagaattaaagatgaggtttttacttatggagtagggggcacttgggatgggtgaagaagggagaactgccctgaagttcttactcatagatgaggaaaaacctcagctttttgttaaaatgagtttatttatttaaaaaatatttaagggggaaatgcattcatttggttaaaaaaagttctgttaaaagtatactatgaaattccccctctttaccccttgcctccatctaattcttatatatcatttcagagtttatttatgtaaatataagtaaatctgaacatatactcttgtttacttgcaccccaacccccatttttatgcaatgatagcacactctatgcatctatataccttttaaaaattttatcttatggaggtttttttccatgtaagtacatagagagcgccctcattcttttctttgttcatgtaatactatttatagatataccctgatttaattaacaggccctctattcagggacattgtggtgtttgctgacctttgctgttacagtcactgctgcaatgaatactcttgtatatacatcatttagcttgtgtgctactgtgtgtgtaaattcctagtggtgaagctgttgcatcagaggctatgcatttgtaattttgttatccatgccaaattgccctcctccatagggtgttaacaacttacacactaagcagcaaaacctctttcctcacagctccacctacaaagtatttttcatgcttttcgtttttaccaatttgacaggtgaaaaatgggcttgtggtaaagtttcaatttgtttttcttattataagtgaggttgtgcatcttttcttatagttgaggtattggtatttccttttctgtgaaatatcttttcataacttttgttcatctttcttttgctaattcttttttttttttttttttgagacggagtcttgctctgtcggcaggctggagtgtggtggcatgatcgcggctcactgcaagctccgcctccgggttcaagcgattctcctgcctcagcctcctgagtagctgggaatacaggtgcctgccaccatgcccaactaatttttgtatttttagtagagacggggtttcaccatgttggccaggatggtcttgatctcttgacctcgtgatctgcccgcctcggcttcccaaagtgctgggattacaggcgtgagccactgcgcctggcccttttgctagtttttaatttgccaatttcttttcttgtttttttagagatggagttggatcttggctcacttcagcctttgcctcccgggttcgagagattcttctgcctcagcctctcaagtagctgggactacaggtgcatgccaccacacccacctactttttgtatttttagtagagatggggtttcaccgtgttagccaggctggtcttgaactcctgacctcaggtgatctgcccgcctcagcctcccaaagtgctggaattataggcatgagccactgtgcccagccttatttgcaatttctaggcactctttatatattaggaagtttaccctatgtgatatgagttatcacaataggaggaaaaaggcttcctggggtctctgcaggttttttattttcctcagattttgggtattctttttgtattttaaattttaacttgtgtttgttgtcatgaggagtcttggtttttgtattgttgaatttatcagtgtttcctttatggcttttgcattatcctggtccactgttaatggcacaaaatcgttcattcctttttccatggtgcctccttcctcttttcctctttcaatttcggattgacagcaaaatgcttttggtatcttctcccaagtttgcgttcctggaaatgtatttcttgtcagtgatagggtagcccttgatagttttgttaggagattttagtggtctgtagcattcccattttcttggtacaggcactctgggaaactgacagtttcttataaaactaaacatgcaattaccatatgacccagcaattgcattcttgggcatttatcccagagaaatgaaaacttatgtttacacaaaaacctgtacatgactgctcacagcagacttgtttgtaatagccccaaactggaaacagtccaaatgtcctccaatgggtgaatggtttaacaaactctgatacatatataccatggaatactactcagaaataaaaaaagaattaaccattgatatatcaacaacatagacacatctctaaagttttatgttgggcaactaaaaagattcaatcctaaaagcttacatcatgtattatttcatttatataacacttttgaaaggacaaaattttagaaatgttgaatggattaatggttgccagtgttttaaagatggaaagggggatgagagaaagagtggggtaggtatagttacaaaagcagcacaagaactctttgtggtgatggaacttttcagcatctgaccatggtgatgaatacatgaacttgtgtataggaaaaaaaactaaatacagacacaaatcagtgcaaataaaatgaggaaatctgggctgggcacagtggctcatgcctgtaatcccagcactttggaaggctgaggcagctggatcaccttaggtcaagagtttgagatcagcctggccaacatggtgaaaccctgtctctactaaaaaatgcaaaaattaggcaggaatggtggcacatgcctgtaatcccagctactcaggggccttgttcaattgcttgaacaaggtttcagtgagctgaggagatcattccactgtgctccagcctggaagacagagcgagactgtgtctcaaaaaaaaaaaaaaaaaaaaaaaaaaggaaatctgcccgggtgcagcggcatactcctgtagtcccagctacttgggaagccaaggtgggaggatctcttgagcttaggagtttgaggccagcctcagcaacagagggagataccatctctaaaccaaaaaagggagggatgggtaggatctgaataaggtcagattatatctatgtcaatatcctggttgtgatattgtaccatagttttacaagatgtttccattgagggaaattgggtaaaggggacacgggatcctatacataggatctcaataaaaatttcaattaaaaaattcccaatttctgctaatactggattcaccaaaacatactgcctggaagcaggttcaggtcaagtaactggtgctctcctgtgttaggacttgtagtgcagcagctgagcagtggaatgtggaggagcctagcagtgcctcgggttccagccctgtatgctgctctgtctcagaagatctgagagcatcgaccagcatttcccaggattctctgggacaacctagctgggtagcccttcatacagcctgtctggagggagagaatactggcttcagctctaatatatcagaacagtgtggtgtggatgttggtggttggggacagtgaggggtggacattggtggttggggtcggtgaggaagggttcccaagatgagctttggccaggtgaggtggcttacactgaggcgggaggatcgcttgagcccagaagttcgagaccaacctgggcagcaaaaccctgtctctactaaaaatacaaaaactagctggctgtggtaacaagtgcctgtggcctcagctactctggaggctgaggtaggaagattgcttgggtccaggaggtcgaggttgcagtgagctaagatcacgccactgcactccagatgggcaacagagcaagactctgtctcaaaaaaaaaaaaaaaaaaaaaaagctttgctgtgccctgcacgtgacctactgtcatatgtattctgtgttccttgtgctgtagcattggctctgctgtgagacagaatggtctggcatgtggtagggcgatcactgggatccccaagaccctgctagggaatctctgaggtcaaaactatgtttgtaataatacttagacattatttgcaaaacatgctcattctcttacagaagtgtccagtggagttttccagaggctaaatgatgtgaaatagcaacagattaaatgcagaagcagctatgatattccagctgttttctattaaggcagacattaaaaagacattaataaaaataaaccagtggcatcatttcacttttttggtttggaagaatattttccttaaaatgttatttttgttaatgtataaaggggttatcattatatttaaatgatttaatatttaagaatgttctcagttttaatttttataggtgaatatcaaaagataaaactcacataaaagctctttggggtccttggtaatttttgagagtgtagaggttctgataattgagaactgttgatttggcagaaagcaataggcttaatttctagactgggctttgctttgtgaatgtgggcatcatttggcctcttcaattgatttcttctcctgcaaatgctattaattgccctgctacatacctataaaaatataatcccctatgcaaatacaggggagattaatggttacctggctaagctggtgttgaaagaaaatgtaaagaatgagtttctggcctgttagctgacagtctgtttacttgttaaatgtctccattttagcatctcctagcagtttctgtatacatttgatttctttttctcagtttttcagacaaccattttaattatttttaaaaattatattcccacattttcaattaataagggatttatattcctagtaccttgaagtgatgtgataaggtcaggagctctgttcttggagaaaccacttactagctatgtgacgtttggaaagttacttaacttctctgtgtcttggcttcctcctgtgtaaatggagctaataatacctcactttccagggcagctgtgaatacgaaaaatcgtgcacaagaagcacttagcaaaagtgcttggcacataacagatgccccataaataataattgcaacgattgtcattaacatataacaaaagatgcaagattaaattgaagtcttaccctgtcttcagtgaacttgttaaactactttattcacaagtttattagcagtaattttaatttcatttcatttttttctcctttgaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagaggtaatgtgctgcgggaaaataacattgctgactggttgttgtgattctctgcaactctggatgccatcttaagacttgacatttgtcactattgctttgaggagattgctttttcccagcagtaaaatgtgatgatgaaaaaagtggtccacagagctgggctaatttagagtttgaattctgatcaccactgatttgcttggccaagttgcttaacttctctgtctcagtttcctcatgtgaaaaatggggctaatagtagtaacttaccccaagggttgagtgacagattgcttagtaagtgttagctattattagtgcatgtaaagtcctgccatactaatttgctctagccaccattctgtctttgaattgactttaattgtttcctgtgtataatttatattttgtttcccagtagattaaaatttctttcaaagcaggagctttgatacgaaaagctccagtgattcttaatggttttatggaaacaattacgcctatttaacccgcaaagtttttaaaggaaagaagcaatgtaattcatgtgaaagtacttagtaaactgaagcacatgatgcaaatgttgtgtaattatcaatctcagtaaataggtacttcctttaagcacttaaatgtatcattgaccagctgctgcacagcacagttctaggggcataaaggaataagtaagtacattttccaaagtttccagtcaagaaaaactttatattcctgataccttgatgtactgtaatatcaaggaaatgttaggagctgtttactggagaaaccacttctgtgaatggcactcccagatttgtttaacaaagtggccctttaactctggtgagagaagatggacatggagaaacaagtgatggagcaagaatcactgcagattaacaatttgtatttagcaatggaggtagtgtatccttgagattacaaagcagtcattagttatattgacagatttaaatttgccaacacctccaacattttagtgcttagctttcataaaatgttgcatgcatatactcttctctcatgggttaaatactattatttggaaaactattaaacatgacctttgatattgcttttcattgatgtggctttgcaaatattataaacttattttactatattatggtctaccaagctttactttccaaacatgactattcattggcatcatgtgagttttttgtttgttttaatactgagttctcccctcctcccagtaagtctaggtgtggtctgtgaatcattattttaataagatgttatggtttggctgtgtccctacccaaatctcctcttgaattgtagcttccataattcccacatgtcatgggagggacccagtgggaggtaattgagtcatgggggcaggtctttcccatgctgttcgcatgatagtgaataagtctcatgagacctgatagttttgtaaaggggagttcccctacacaagctctcttgcctgccgccatgtaagatgtgactttgctcctcattcacttttagctgtgattgtgatgcctccccagccatgtggaactgtgagtcaactaaacctctttcctttataaattacccagtcttggatatgtctttattagcaatgtgagaacagactaatacataagtttaccaaatgatacaatgccaccctctattacccaggatttgggaaccagtggtcttaagcactatttctaaaataagttctacaaaactagtcccatataaagaggtcaaacgatttgcatattccctcaccaccccttggaaagtcacaaagcgtattatctcacttaaagttcttaggagtctcacaataaagaaagccagacttttgaaacttagttgacctcagaacacttatcttaggtaacatttattaatgtcccataaagtagtgattttagaacattctttgggaaatgctattgtagacataagactttacctttttaatttttttagaaacagagtcttatgctgtcaccgaggctggagtttagtgataacattcatagctcgttgcaacctctaactgctgggcagaagcgattctccaacctcagcttcctgagtagcttaggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttattctttttaaaaagtcctttaagttcaagaccagcctggccaacatggtgaaactccatctctactaaaaatacaaaaattagccaggtgtgatggtgcatgcctgtagtcccagctcctcgggaggctgaggcacaagaatcgcttgaacctgggaggtggaggttacagtgagcccagatcatgtcactgcactccaaccagggcgacagagccagatttcatctcaaaaaaaaaaaaaaaaaaaacgaaaaacaacaacaaaaacctctaatccatatctgttgttttgcagtttagtaaagtgtggtacggagagattaactgactagctctatatcagagagctggggaaagtgttttgtagctggaagtaccagacagagcttctcattatagcacattttcaagacttcagagcagtgtttgtcagccctggttacatgttaaaattactcggaagttttttcctccaatatatatgatgggaaattttacacatatactgaagaagacagggtaaaagaaggcggagtaacacagtgaaccttaatgtactcattaccagccactacaatcatcagcttgcaaatactcctgttttatccatatccccactccctgccaccctcaactgtatattttatagtaaatccccagacattatttcattcataaatatttaagtatatatctttaaaagtgaaggattcttttaaaaaataacttttaaatttgaattaattttagacttggaggaaagtcacagaaataatttgagagtacctatataccctgccccatgcagcttcccctaaagttaacactttacataaccttcgtacaatgatcaaaaccaggaaattagcttggtacaatactagcaattaaatggaggccttattttgaattttaccagtaattccacgaatgaatgactgagtcgttttgaaagatgtagttataatgctgttatacctaaaatatttaacaatgataccttaattcattcagcatagctgaggtgctgttaagaaaattctgatgtctgggtctcactccgaaccgattagatcaaaatctttgaagggtgatagggttagggcggtgggatgttgggtattggtatttatgaaggtgctctaggtgattctagtatgtaaccaggggagaaccagtgttttggagcattcatttaaaaataaactgactttggcgggcgacatggctcatgcctgtaatcccagcactttcggaggccaaggcaggtggattgtttgagcccaggagttcaagaccagcctgggcaacatggtgaaaccccatctctacaaaaaagaccaagaaaaaaaacaaacaggcatggtggtgcgtgcctgtagtcccagctacttgggaggtgagaagatggtttgagctcaggaggcagaggttgcggtgagccgagatctccactccagtctgggctacagagcaagaccctgtctcaaaaaataaaataaacagtttaaaattctgtttgaagaactttgggattcactttgaatagtcagtaattacccaggattattgcaaaacagagaccagcactcacagtactgagcaatacctcagcagcgtgctcgggcagaggaggtgagtgcagttttggggctttcattggtggcgtaatgtgtccgtcttatctctgttggtgagtgttagcaaactcctgaatcatatccgtccgtctatgttcacctcagacctaagggttgaaattagtcacttccaaatgagtaaagcagaggatgtcattttgatcaaacaccaactctctgatattattccagatgtttcctggaaatttggttggaaagatgaggaagtaacataatgctatgtgttgacaagtgagggaacttaataaccatggagaatatgtgttagtggaagtatataaccgggatcaactagaggtccctaagattacagtacctgtgatcacttaagtctggatcaaagggaaacatggctataactatttctgattcagataaaggaaaatcagagagttagctcagctttccttatgttaaatttggatgatgctcttgaatgaaaagcttatgtttatagatttgtgtatgtgagggagaagaacggaggtaatttactttgcaatcagggagtctagtgacataccttaactactagtttctttaatggcgataggctgacccctcagccagcactgttgagcagctattgcagacccacctagtggggaggtcctttgggggttccagagacatgtaacatggtccttgctctttgagagtttagcctcgctgagggaatgaagatatacagaacagaaatatgaaaaaggcactgttgaaggggaatgctcatttgttatttataactaaagttctgtaagagttaaagattgggatatcctggagcagacggggtttaagctaggtctttgaaaaaaaaaaaaaaaccaggatttgggaaatgagaggaagaggggggcattgctgcaggggaacagcttgacagtcttagaagaaaattaactttggggcttcagggacactgaagaaactggcctgagtttcagtgagcttgctcagagaaatctctgcattaagaaccacagaatgttggaattggaaggaccttagagaccctctggtccagtgctctcattattcagatgcagaaattaaaggcttttacagaaagtaagcacttcgcccaggtcacacagtgaggtagtggccaaaattaagttaaaagtggatgaagatcaaaggggattttttgttatgcaggtggtgcacttgaacatgtttacaggatgagggggaagaggcagatgagacaagatcaaagatgaaggagaaagggggattcttagagcaagatccctgaggaggcaagagttggagccttgtgggacatctgttctgagagaacagggaggacgcaggcaagtttatgacaggagggtccctggcacagatcggtcacacccagcagcttgtatcctctgtggagaagagggaggtcatttgttgagtggtcatggtgactgggtacagtaatgagtgccattaggcattgagggctcagctgaggcagggcaacttgtatttgctctttgtatttgcagacaatttggcagaatggttctgagcgtaaactccagagccacactgccaaggttcaatcctggctccatctctgactacctgtgtgacctcaggcaagtcccttaattcttctgagcctcagtttccttttctgttcagtgagaacagaatgacatccacctcaggttttcgtgagggttcaatgagttattcttggtacagttctagggaccacgcctgccatgtagtagacactgtagtgttagctctttgttattgctttaaatataaatgatgactaaggagaaaggcctatcctaattgccatgaattggcccatttgaaattacttgataccagcagctgtctaaatattgccccattttaagttctgctcttaacaacccaagtataagcactaaatagaggcaaggcaaaaaaaaaatttttttttttttaagcccactgtggtttccttcaaaccctgcaggatttctttcatgccatgaatatgtagtttttggaatttctgtagtgaatttaactgtttattctgctttgtggatagcatactcgtgcctggggaacatgggtcttgagaaatgtgaagctggatggtggcaaaccattagtccttggcttctaggctgtggatacatggctgcctctgatttgggggatttcctgtatattgcctcatttctagttaaggattcaagttgacagacacttagttttaggttacatctatcattgaaatgtggggtaactgaaaagccaaccagaaaggagtgtgcttcctccccaggtgtggtttccctgggggcgagggatgaggctggtggcaaatacgcagccccaggaagatgcagcacagacttttggagcttctcttgtcacttccctgggtcttacttctgcctcattctagttgctgtcagtgggtaaatgtgttcatagattagaacaagttgcagcacagacttttggagcttctcttgtcactgccctgggtcttatttctgcctcattctagttgctgtcagtgggtaaatgtgtcatagattagaacgcctttgtaactaagataaagccacaagctttattttgttacagttcctgtgtgcttgcttgaaggccttgagagtacattcatgatatgattctagtaactcctgttttaattcttagatgtgttgataagcatagtgtattgacataaaccagtatgaagcatggagggggttcagatgaactggtaagaaaaacttgcaatccttggaaagccatatgattacacaggattatgaagaggccctaaggtttctctaatttagccctttcattgtgcaaataaagaaaccaaggatcttcgagtgtatatgggatttgctgggtatctttccattagataatgactaagatggtattagaaggtgagtcatcttttccactgcaccatactacttatgttctgcctctttggagtccttcatttcatttttggttattcctttttttacatggtaggtcctcaactggtgtttgaaggaatgcacgagagttgccattcatgggcctgcacacagggctgggcagggatttctttctgtcatcggtaccgtaatgtttaagacccagctggagtcattttccaagtatttgacctgacttcctgtactgtgtgtcctcccagggagagagactgatccagattaaatgagtagttccgagtgttgcacagagcatcactgtctgaactggcattagcattcactttgagctcctttggttaaaagcctggttagcgtgagctgttggccaggtgaaactgttgctatcgccctgacactgtgaaccgaatctcctttaaatgacaacattgttagagtcctgtggccgcttttaaatatattttggcttcagttgcttctttcttgacctgaaattataaaatgagttgggagtacctattgcaaagctgcaaattttgacaagaacattgagatgtcggcttctttttgctgaaatcctgaggcaagacatttcaagaaaattttatgttcccatagaatgtcacaagttactctggcatcaattccaggttgaaaccttacagtgtaattatagtttccccccttcttgtcctttgggcaacctttcttttctgtaagaaatacaactggtcccctgggtggcaggaaatccaggtgggggagtgggctgcttctggttcggcggactgtaaggtatgctgcacagggcttccttgggcctggccccacacttcctttgcaccagcactgtcctgccaaaagccagaaatcctggaagagggccgaatctagtttattacttgcctgttggaaatgtaggcttgtgttttttggcaaggcatgagcagagcccggttatttgactgctctgagatttaactccattccgcttttggacaatgacatatgagcatgtgtgaacagcagccccatttccccccagtttgcctgccctagacatgccctcagacagctggctctgccagctttcccagtgccaggttctagagcccctgttcttctccctcccctgctcatttccagtccaccagagcgggcagtgtcagaggtcccatgcagcctcctctcttgtgaggaaccccagagcacctgtagtctctaagccaactagccagtattgagggctcctgggttatggaaatgaaaccagggctgggaaaagatattccctgtcctgtatcacttccaatgaagagaaacaagaattttagcaaattgaacattgctgcagtgcctagaacaatgcctggcatgtagtagatgttgaataaatacttgtttaatgaacaactttatattcttcaattatctcatcctagggactgataagttttctcattctatcagagaaaataaaggttatgagggttgcattaggtagagtaagctaggctacagctgtaagtagactcaaagatgtgtaatggatcaaatgcaacagaagtttatttgttgctcttgttcaaggtgggtgtttctggttagcaggtgactctcctccattgagttcagggactcagtttccttctatcttgtggctctgccgtccccaaagaccaccttgctgatagtgtccagtggcaaaagggaaaaaagagtggactagcacagttaggaggttcttacgggccaaacctatgagtgttgcctatgacttcggctagaactcaattacatggccacagctaactccaaagaggctgggaaatacagtctattgtgtgcccaggggtacactaaattttgaacatctgtgtcatcttcgaacttagattcctaaaatgcatctgcagcccagctttgagattcagaaggcctgatgcaaggttccatggtaaattttgcttggtttaagtcctcctgccaatgaaaaccaagtgacattaggaacagatctaacaataagttaaaaaaaaatcaagctataatagtttatattcaatatgatttcaactgtgttaaatattctgtttgtttattttagagcagggttgtccaatattttggcttcccagccacattggaagaattgtcttgggccacacataaacatattaatgctgaggatagctaatgagcttaaaaacaacaacaacaaaaaaaactcataatattttaagaaagcttacaaatttatattaggccacactcaaagctgtcctggactgcatgcagcccacggccgaacaatcttgttttagagacagggtctccctggtctccttctgttgcccaggctggagtgcaataccacaatcatagcttccggtagcctcaaactcctgggctcaagtgatcctcccacttcagcctctcaagtaaccaggactacaggtgtgccacctacctggctaatttttaaatttttttgtagagacagtgtcttgccatattgcccaggctggtcttgaactcctggcctcaagcaatcctcctacccacctccccaaagtgctgggattacaggtgcgagtcatcgtgcctgcctatgttaaatattcttaataaatgattagacagaaggtaacatgacagtgacttaattgtggttgccctttagagatgagattatcagtggtattttgttttagcctgcttctgtttttctgtattttacaagatttctatcttgaacatgcattgctttttttttttttttttttcaatttgaaatacctttttttttttttttttttttttttaaactgatgggtaggctccatcttcagagattctgagccagtgggtctggagtagggcctggtacttgctcttttattttttaatttaatttttttacagagagtgtcttgttctgtcacttaggccagagtgcagtggcacaatcatagctcactccagcctcaaactcctaggctcaagtgatcctcctgccccagcctccccagtagctaggattacaggtgcgtgacactatgcccagctgactttaattttttttttttttttttgtagagacagggtctcgctaggtttcccagactgaccttgaactcctggcctcaagcagtcctcccacaatggcctcccaaatgccaggattacaggcatgagccaccatacctagcttctgttttgttttgttttgttttgttttctcacagtatgtgaatctcataagagttccatctccctgcctgcagctttttgactcaccaggataggaatatgcctctgagaactttttacgcacatgcctttacatgtctgcttcatttatgaactagtcagctctgtgtcaggccctgttgtaggtgtcgaggaaatatcactacaaaacagacaagaatccctccttcagagaccttacattccattgtggacacagacaataaacacggtaaaaaaataagatagatggcatgtaagatggtaaatacaagaataaaaaaaaaaagtaaggggatataaaatgtcagtagggtagaaattttacatggggtgacacagaaggccttcccagaaaggaacttttaatataaagacctgctggtcagtacagagctagccaggagactcttctttataactctgtctagatctgaaatttatcaggttatttgaccaatggcaaccccaaatcccaagattctgttctttactatcaccctgctcactgtcgtgtttatctgaatgttctgaactagagtcttatttgctatctctgttgttagttggtaggagacttgcagatctatactccttttaaaaacatctgaattgttttagatctcagggactcccaaaggatttcatcaggaggtgtccctaaagcttgaagcagcatttaattttcttctgcccacgttgacagactgactatagtattataagactttagttgacgtcctggcgatcctccatagttttcatttacacatgagtagagagcatttcacttgtctaaggtcctttcacaccattgctggaaactgcccatgacagccaacctgcagcccagagcaaaaggcataatgaatgtggaaggactctgcaggaccatacggagctatgtaaaagaaaggattattttgggggtgtaagagtcatttatatcaaatgcagccagacaaggagggattgcaaaatgttattctgtagaagtatgagcattagtggcgtaatacagcatcattacagtgatggtttcttcctgtatcccaaagtcccccagcctcctctcttcccctttctacctggaagtttacgaattctctctttgcccttgctgagacttagattctctggagtctgtcactcacctgcctctccatcagatattgtaatagtcatagttgtattctgcaaaatccgtgaaattcacatggctctagcctgaaatgtccagcctccactcctgctccctgacttctgctgtgccccctcctgctggtgtctgctccccttctctgcctgaggaatcctgctctcccatcagcaaccgccaacatcctggcacatgcagaggtcccggtttcccttgatcacaagggacctccttccttatgcctccctggtgcacaggaagtgtttgctggaaccgtttatgtggtaaagttgagtcggtgcctcagccatctgcatgaggaatgacatgggcctctggactctagatcaggctccagcctgatgtcccgagcagccatctatcatcctgcccgggagcacaaggcagccccagtggcagtataccaaatcattagaccaatatcatcattgtcccatgtgcggtatcttggttctttcttcaggcacggggtggaggattttagctgtaaaatatttacccacgcaccactgctaagctctgttctctgagtcaaaaaggggttgtgttcacacatggtttgggtgcatacacgagggaattacagagcacatagtccagttttctattgtttcattaccttagctgaggttttaagatgttaagtgtgtcactttggtcacacaaacttacttttacctctctttaattctggacatcggaaaagggagtccaggttagtggcgtggcttggagcctttccttcactatccacctgctgcatctgtggaggcttctccagcccctcacctgatgtggtagtgacagcagcaataatgttgcagctgtcgtttttacatgtttaccatgtgccaggtctagaataggcattttgcatatatcagctatatttcacgatcagctgagattcagagacctgaatgtgttcccggttacacagttgtcgaagtggagctgggatgcaggctcagagctaacgtccaccttcgaaactctaaagccgcgcttcctttccacctctttgtccattgtcttcaattcttttatttttatttatttatttattttttgagatggagttttgctctttgtggcccaggctggagtgcagtggtgcaatctcggctcactgcaactcctgcctcccgggttcaacggattctcctgtctcagcttcccaagtagctgggattacaggtgcctgccaccacacccggctaatttttgtatttttagtagagatgagttttaacaatgttggccagctggtctcgaactcctgacctcagttgatctgcccgccttggcctcccaaggtactgggattacaggcgtgagtcaccgtgcctgaccttgtcttcaattcttttttttttttttcttttttttgacagattttcgctctttcgcccatgctggaatgcagtggcgatctcggctaactgcagcctttgccttctggtttcaagcgattctcctgcctcagcctcccgagtagctgggattataggcgcctgccatcatgcctggctaatttttgtatttttagtagagacagagtttcaccatgttggccaggctggtctcaaactcctgacctagtgatcctcccgcctcagactcccaaagtgctgggattacaggcgtgagccactgtgcctggccgtgtcttcaattctttaaggtcttattctttcatcctgtctcctgctcatgcccaatgttcaagcatgttcccttaccctgtattcctttataatactcgctgcatagtgtcacagtatacttagcatctcaaaagcagtctttataggatgcaaccacactttaaaatagccctgaagaccccacatttacgttcttgaagtggcaactccgcctaccttgcaggtaacttctttatacttccaaccgtgctttggagaatggggctttttaacagtgtctcagaggactgtggtggtacagaaggtagacagagagtggactcatgcctaggagcttcatccttccccactgccactctggaggggttgcagagagggagcctcgaattagtcagaaagggctggggtgcttggttacagacggggccttttccaggaggcaaaagatctcagatgtctacgtgccctacaccgctgtctttcatgggacccgaggaaagctctcccaaggaacgggaggagtgggacttctgtccctcaggcttttatttttacttgtgatgtttttcttttcctggtttgctgccatcaatgccatttgcaaggccttttgtggggaggaggtataatctgcctgtttagttttggaagctgcttaaaggttttaggatttctgtcccactttcccacctagacgtgatgccaagggtaagaaggcatcggggaaactgggcaagtcgtaaagtaattattggaacagtcatacaattcaaattcctgccgttctgatatcgcttaattcttttgaagacctgaataaaatgtgttctttttctgagacatttagatacattgtttgaacaaaggaaacagggtgacttcaaaatgtccagtatgtggaaatcgatgccgttcagcctgtggtgtaattaatgaaaacattggcgacagtcggcctcattgtttgtcattgtgcaacaggaggtggtacactaataaggagccggggaaggtttacgtaattcagaaggaagcagacgtgtgcagttttgactgatgcccttctcactgcagatccaggctcaccgagcaggttcctattcctgatggacgtggagatgtctgattggattttgtcatttgatttttgacactgattaatgatagatttttatttcccttatggtcagaaataattgtcttgaaaagcttcactttagatcatagttttcacacacagttataattcattgggtaaagcatagtagaacaaactatggaaaaggaaatgtcattggtagactttggtcgcttaggacaggtgtggtggcccttggaatcaggagatctggagttctgtcctggccccatcagtcccagctgtgtgagcttagggatagtgcttgcccactctgggagcagccttcatctgtaaaaggagggggttgctcaggacccttgcacctccttccttttacagatgaagattgctttgtctaagcccccttggtgaggtcaagaattgtgaaatgtttgtacaagtgagatgtcaagagtacaaaatgtacagacgaactgccagtgaaaatgtcatttaagtttatctgctaacagtttattccctttggtctcctctcagtttttgttttgtaattgtccatgttttgtctggtaatttattattttttttattagaaaagtaaacaccaaagtgtttttccattccgcttgacagcataacaaattgccatttaaattcatctcttaaggatttcaaaaaggcattaaacacactgctcaacatggtatgtatttaattgaaatgagctgacttttgaattaattagctctttagaaaaaataggcaaaaatggagccgaaaagcatgggtttgaattctggcttcactgctagtacgagctgtgtgaccctgggcaccttttctcatctctgaatctctaatttctcatctctaataggagagggacactttccctatgagagtgtggtgaggtataaagataatgtatgtaaactgcacagtacagtatctgacagttagtagatacttaatggatagcagctgtaactgttatacattattttattacaataattaaaataactagagaatttgtgtatattatatactgggttctatctaccaaatcattctaatatgatgtgcattgattaccaaaagaaatagtcctccagtatggatgccagttttgtttctgttagagtgtgtggagtgagatttaccagagagggatttctcttttctggttgacagatcaaaggtacgcctatgagaatacatggcaagaatttattcttttttttttttttaacagtgataaaatatactttactttgttgagtcagagggttgtaaaaaaaattattgctaaagtaggtatcaggcaaacagaaaggtgctttagaagtccagttaccttggagtttatttaaactaagagaaaaacgtcataatgttttcatgcgatacatatctggttctttaacaattgtgtgacaaacagcagaaggaattaaggaatgccgcacttgtgatccatacaaaacaccaacactttaggttgtacataattaaagaaatatctcaaacactttttaaaacactgtagtagccaatacatagaggcatgccgtaggtaggcacaggaatgcagtttagaaaaataaataaatcacataggaactactcaatttccttaaaatcactgagcaagaaaagcaacattgaactggctgggcgcagtggctcacgcctctaatcccagcactttgggaggccgaggcgggcggatcacgaggtcaagagatcaagaccattctggccaacatggtgaaaccccgtctaatttttgtactaaaaatactaaaagtactttttttgtactaaaagtacaaaaattagctgggcgtggtggcgctcgcctgtagtcccagctactcaggaggctgaggcaggagaatggcgtgaacccaggaggcggagcttgcagtgagccgagatcgcaccactgcactccagcctggcgacagagcgagactctttctcaaaaaaaaaaattaaaaaaaaaaaaaaaaggaaagcagcattgaactttcatattgattttacacagcttttatacagtaccttgacttaaatccaagagcaaaacttgactgtcctcctctatttttggtaaacttacgtgactttcccccctggattttacctgggagtagcctttttaaatttttatttaaaagagggcaggtttggcactttatagtaatgtcaccaatgttaatatttcttgggatctcaggaagattcacattttttacagctgatacaggttcagcacaggctgaagctccccctcagccagcctcagatttttccagcttattttgtgcaccaatttgtgtaacaatcccattcatgtttgtctccaataccattcccccatcatcatttctgcaagaatattgtgaaccgtgtctacatggaaaatcaaatccagttcacaaacattttcaaaacatttgtctaatgtttccacaaatccatagggctggtagaacttggagagccgcggtttcccatgattgttaagattaggatcgccttgatcgtggctgggtcgggcccaccgggtaggcactgggggccagggtgcgggccggcgcgcaagcctcgcctcgtgatcttgccggcgatccttccccacccactccctcccgcacgccggcaagagtttattcttacaggctgccattgcaaactactgtcttcagaaacaaggtcacttcaaagtgtccagaatgtggtaattggtgccattcagcctgtggcgtaattaaggaaaacatttgcccattgttgtccattgtgctagagagaggcgtccaggaaagattcatactcccaaaccctccatgggagtggtgatctggagagggtcggacagccagaaagcacatagttgaccctgaaaggttttgttgcagcctgtcataccctaacctttataatctgtctgaatctctactgcaggtcaagtagccatggtctggtggggatagaggtggcaggtgggctagaacgtgccatatcttgatttgtggcaatgggcctcctactcttcggagtggagacagctaataccatgagtcaaagaccaaatcgggatagccgatgtataaaaacacaagcaccgggtttgcaaactggaagaaaggtcttgaagaaggtgtcagaagcaaaaaatggtaagtatgtgaggaggtggatattttaattagcatgactatagaaatcatttcactatgtatatgtatgtcaaaacatgtgtgctgtaaatatatagtttttattttttaaaaaatgaatgctgtcagtatgagtccatttaaaaataagcaggcttaaaggttcaaggaaattgctgagaactggcatctcacgcttccttttggggttagtcgatgcatggtatggctaatgtaaagatccaggatcttatgaacacagctttttaccttggactgttcctcttgcagactcagctaccaccttcctttaggattaaaaatgttttacttagcctcaacaatttgttttagagccactttcatagtgcctagtcctggattcccaaataggtttcttcatcttcgtaaactcgaaagtggccatctggggttcagtgtcaggaagggttctgagtccaagtcagatttaaagaataaccatgatgcattactggtatctgtcgggggtctgggagaaggaattgaatgtatttgaatacacttattttattattttttaaaactgagttatcattcacgtagttcacccttttacagtgtgcatttcagtggttttagtattcttgcaagattgtgcagctacaccactatgtaattccagaacattttcatctgcctagaatgaaactctatgtacatcagcagtcactccccatacctctattcccctatcccctggcaactaccagtctcctttctgtctctctggacttgcctgttgggggtatttcatataaagggaatcatgtgatatgtggcccttgtgtctggtttcttttacttagcataatgttttcaaggtttatccatgttgtagcttatatcagtatctcatatctttttatggatgaacaatattttattctatgaatagaccacattttgtttatccatttttcagtggatggatatttgggttgtgtctactttttgcctattatgaataatgctgctataaacatttgtgtacaaggttttgggtgaacatataatttacttctcttgggaatacatgtgaagtgaaattgctggctgtatagtaactttatgtttaactttttgagaaacggccaaactgctcttcaaaatgactgtcccattttacatgcttaccagcaatgcacaggggttccagtttcttcacaccctcactaacatttgtcattgtctgccttttaatttgagccatcccagtgggtgtgaagttgtattctttctgcttttgattgcacttttctaatgtccagtgatgttgaacatcttttcctgtgtttactggccatttgtatatcttctttggataaatggcttcagttataattccaaggccagattttgccctagggacagtactgatttatatagttaggctgactgcttcctaattgggagaattggtagttctgaatttcagaaacatctgagaagggtggatattgaagctttatataaaatatgtagcagttttcttttaatgtgattatgatttgggaactttttagttttactaccatgaaaaacagaacttccaagcatactttgccattcattgttagaataatataaacatacatgtttatagcagtgttctgttttcagatcatcctacatatattatctcattataaccattacaacactgccgtgaggtaggatgaatattagccattattatccccacttttaaaaagtagaagctgagagtcagcttgtgatttgcccaagttcaccaactagtagaatttaaattcaggccttctgacttactttgttaatggtaatgaattattagtgatgtcagggatttgaagggtgagcttacattgctaaaaatcagcaatatgcccatcttcaaataacagattgttactgacttcagaatgtattatttgaatagctgtaaaacaggatgaattgttacttttccatttagcctctttagctacaaagtacttacaataaaagagcagaattacatatcactgcctgctcattacattttgaacccagaaggaaatccacccaaagaaagaacaaagctgggaatggatttagaaccctaaaaagaggcagcctttggttagctgaccttgaaccatccatcatgcctcctcctcccagcctccatattcctaaactgacatccttggggaacaggaatttaaatgtagaacgagtgcagagaaagtgagatatctattgagatcaaataaaaattgaccttgagactaacattaactgacagacaccacattaaaagctaaacattacctttaaagggtgggaaagatgagtgactttttaaatgccgtcttgagctgggcacagtggcttacgtctgtaatcccagtactttggaaggacgaggagggcagatcacctgaggttaggagttcgagaccacctggcctacatggtgaaacgctgtctctactaaaaatataaaaattagccaggcgtggtggcacacacctgtaatcccagctacttgggaggctgaggcaggagaattgcttcaacccaggaggtggaggttgcaatgagctgagattgtggcactgcactgcagcatgggcaacagagtgagactcggtcttaaaaaaaaaaaaaaaagcagtcttgattaagtccatatgcagtcttttttgtttttaacatttcttttaaacttaagtattttggggatagaaaaataagtctattgatcatatggatgtgaattttgttaactgtgaaacacagcttacctactcatttttcttttgaccatgagggttattaaatttgcttttgatcatttcatgcatatctacatcttaagtttttagaatttaaaagttgtacactatctttatgaagttcttactgttatgttgcacatcttttctaacttaaaataagcccttgtagtatgtcactaatttggaaaatttacctttactttgaaaagaactacatcaagcatagtgaggccaggtgtggtagatcatgcctgtaatcccaacactttgggaggctgagcgggtggatggcttgggccaggagtttggagatcagccagggcatcatcttgagaccccatctccacaaaaaataaaaattagccaggcatggtggcatgtgcctgtagtctcagctactcaggaagctgagatgggaggattgctcggacccaggagttcaaggctcccgtgagctatgatcaggccactgtactccagcctgggcaacagagcgagaccctgtctccaaataacaaaccacagtgacatctttcataggatgacccatctgcctcaaaccagcatcaaagcttattttatgaggaaaatttatataacaaaagtttttgaagcaccgtactctcttgttggagaggatatcatttattaaagcttttggttttgctttcaaaatattttttgaaaaatatacatgtacgcatgtacgcctatgtatttttatttttaccatattggatagcatcaaacagtggtaatagttattctcatggctaaacatatagattaaaaacacatggaaggacttgtaggtaaataatgatttcagttattacgtagtgcgaaatgattctatcaggaaactgtgggatgagtaatgtgactctgctgtaagattttcagtagcagaagtacagaacaaaaataaaacatgtcagcaaaaaacacaatggtaagttgtcatctgagtgattgtgtaagccttgaagatagttaatgtaaccgagatgaggcgtccacataagctcctgccttcacaatagatatgttgtgtctatttggatatcacaaaatgtcattcggttttttattctgctttcatgtactacatttcttatcttgctttttcattcttcatgtaaaagaggtttctagacagagtttctgtttcagttcacatatattttatcacttatggagctcctttttcctgggaactgttctaggagttttatacattttatctcatttaattctcacgtcaaccctatgacgtaggcattgtcaatttcaccaattttaggggacagagcagctgagggtcagcaaggttaagtaactggcttaaggtcatgaaggtaatcagtcatctgcagaagcaagattttgactcagttctgtctgatgctactgtcgttatccataagcgatgtatgtatattttagttagaaaactggaatgtttggccgggcgcggtggctcacgccggtaatcccagcactttgggaggccgaggcgggcggatcacgaggtcaggagatcgagaccatcctggctaacacggtgaaaccccatctctactaaaaatacaaaaaattagctgggcgaggtggtgggcgcctgtagtcccagctacgcgggaggctgaggcaggagaatggcgtgaaccccggggggcagagcctgcagtgagccgagatcgcgccactgcactccatagaagctctctcccctccccacaaactctgagtcactcagcttgagctcaggaatgatttcagatgtctaaacaggtcatttgcagggtctgggtagtctgcccacagaggaggtaaaagctctggctcaatcttgaaccattgcaaatttaagccagtggatctgaaggcaattgagttctgttctgccactccagctcaggcaggacagctgcttccctgaaacagggccctctgaggttagatgtacagcctcagtgggcatcagtgtcatgaatagccgctcctcatttggcagcagtaactatccagagacaaaggataggattcgggataaccgtggtcataagctagaagtctccagagtccttagaggaatttgaaaactgaacagaatttttttctttccacactgtgtcagggctttagcaaaggagttctgttgtgacaattgtctgggtaacatctgcctactgttttttgttttgttttgttttgttttgttttcctgatctgtagtccatcttgcttaacagtgcccaagggcacaagcttcacactgttaatagttttactcttaacacctccttggctcctttgtcccaagaaggtgagatcccacttccaggtgatctcctgcaggacttttccctgagcctctaacccatttctagcccatatttccccctcaagaacaataattcagtaatgttttcagttctcctgaaacaatcccaaattttggattttttcttaatgttgaattataagagttattgatatattcattctggatgtaagactgtcatttgatatatagtgaaattttttctttctttgtttatttttgcccattattttcatagggaataaaatattatgaaatgttctcagtctgctgcttgccttttcattttatttcttttcttttctttcctttttttttttttcttttttgagacagtctcgctccgtcacccaggctggagggcagtggtgcgatcttgactcactgcaacttctgccttttgggttcaagagattctcctggctggccacggtggctcacgcttgtaatcccagcactttgggaggccgaggcaggtggatcatgtggtcaggagcttgagactatcctggctaacacggtgaaaccccatctctactaaaagtacaaaaaattagctgggcatggtagcacacgcctgtaatcccagctactcgggaggctgaggcaggagaattgcttgaacctgggaggtggaggttgcagtgagtcaagatcgcgccactgcactctagcctgggtgacaaagccagactccgtctcaaaaaagaattaaaaaaaagagagagatagtctcctgccttagcctcccaagtagctgggattagcaggcatgtgccaccaggcccgactaattttgtatttttagtagagacagggtttctccatgttggtcaggctggtctcgagctcctgacctcaggtgatccacctgccttggcctcccaaacttctgggattacaggcatgagccaccgcacccggccttaatggtatctttttaagagaagtttttagttttgatgaaaatcaatttaaccatttttattttatggttaacactttttgaaacttagaaatctttgcataccccaaggtagcaattttttttttttttaaagacagggttttgctcttgttgcccaggctggagtgcaatggcataatctcggctcactgcaacctctaccttccaggttcaagtgattctcctgcctcagcctcccaagtagctgggactataggcatgcaccaccacctccagctaatgttttgtatttagtagagacgggatttcaccatgttggtcaggctcgtctcgaactgctgacctcagatgatccacccgtctcagcctcccaaagctctgggattacaggcgtgagccactgagtccagccaaggtagcaaagatttttctcctatattttcttctagaagttttatagttttagcttccatatttaggtctgtgatccattccatattaatttcttgtgtatgcactgtgagatgtaaggctccaggttcattctttctctttgtggatatctagatattctagcacaaattgttgaaaaacttttttcccccattaaattgccttgagatctttgtaacaacaataaaaaaatcaattaacaatatatttttagatcatttttacactgtcttttgttttatggatctgtgtgtctctatgccagcaccacactatcctgattactgtagttttatagtaagtcctgaaatcaagtactgtaagtcttcaaactttgttctttcaattattttggccattctgtgtactaagaatcagcttaccaattcctgtaaaacaatgccttctagactttttacttggattgcaaatgaacctcttaatcaatttggcaagcatcagcaccttgaccgtgttgaatctgacaatccatgaacatgatatacttcatttcttgagatcccttttagtttttcagagcgatgttttgtaatatcagtgtacagatcttatacatattttgctgaatttttccctaagtatttcatgttgccgacgcagttgtaaatagtattcttttattccactgtcctgtcattcattgttatgtagaaatacaattgatttctgtatgctgaccatgtatcttgcagccttgctaacttcactttagtagtttttagtagatttttaaagattttctaagtgtattatcatgtcatctgcagataaagacccttttgcttattcctttctaatttctttgccttttacttaatttattgcattggctactgcatatagtacaatgttgaatagaggtggtaagagtgtagacatgcttgccttgttcctaatcttagggagaaaagtgtctttcaccaataactgtattgtcagctggaagtttttcatagatgcactttatcaggttgaggaagtttccttctgttcctactttgctgaaaatttccataataaatgcatgttcagttttttgagtgctttttcttatatccattgagacaatcatagatttctaacctctattctgttgaaatggcaagttactttgattgatttttcagatgtcgaaaaagtgtgtctccttgacataagcattgcttggtcataatgtattatcctttttgtatatttctggattttatttgttaatattttgagttcatgtactgagtggaccagccaagtaggcagatgggcccgcaccatccatataaggtatttggaacaactttgagcacattctacagatgcctaataaccttagtgaggcctgcagttctatgctcaaataacctccccttctttttcacttgtcctttgaaatggactgccccagagatggtatatgaatctgtagggcaaagtttgaagtatgagcttgagtaaatgatgagttccttgaagacaaaggctttattgcattcttttttttttttttttttccccctgggatagggccttgctctttttttccaggctggagtgtagcggtgtgatcacagctcactgcagcctggacctcctgagagcaagcaattttctcacctcagcctctggagcaggtgggactacaggtgtgttccatcacacctggctaatttttattttattttttgtagagatgaggactcagtgtgtcgtcgtggctgctcttgagttcctgggctcaagtggtcctcctacctcagcctcccaaagtactgagatgacaagcatgaaccaccgcacctggccagcattcctatctgtcagtataagattatattaactagtgttacagaaaccccaaatgatggtggcttatacaaaatgaaagtttattcatctctctcaggcctggtctcctcttacacataaacatcctcatggacccaggctgcttctagctcatgatctgccaactcaaagatgtaaccttcattattctcatggtctacatggggtgcacctgcatttcagcagcagcagagtggaggaggggacagtgaagaagagaagcaacaaagagtgcatgccggctgcctttccaggaaggtgcctggaagctgccaggagagacttctgcatgcacacaccactgattataacttggtcatgtgtcacggcaaggcgagggttttgaggcaagagttgtggagaataaagagttgttcactttctatttgaaaatcagctagtttattcatttaatttttcttaagttcctgaaacaaagttatttgcaatttatatgtttctgggcctgagtttcctggaatagtaaagtcatgttaacagaaacagtggaaaagaaaattcatgttaatgtacacggtaagctgtgtgggtgtaagtagttttggttctcaatatctatcctaggacctcgcatagtgcatggcacatggcacgtgatgctactcaataactgtctgttgcctgtgtggtaatagctcacacttacccagtgctcactgtgtgctgggcaggatgataatgttctccttgcagaatctcatttaatcctcaggacagtcttttaagtggccactcttgttatccccactaccttgcagatgaggaaaccgaggcttacgtatattttcattcatttattcaacaaatatttattcaggacctgctatgtgctgggtactggagatatagcagggtttaaagcacaccaaatccttgctctcatggaatcagccttctgggtaattttctaaaatcacatagatactgggtcgagggtagcccttaaacctaggtggtctgactcctgaacttgcaatcttaaccgttgttttattggtagatgaatggattgatgagtgtggtgaacaaaaattgtgactatccatttcacaaacagcttcgtggttgccctttagctccagcttggatggttagattgccctgtctgaagctggatttattttattttatttatttttggagatggagtctcgctctgtcacccaggctggagtgcagtggtgcgatcttggctcactgcaacctctgcctcctgggttcaaacgattctcctgcctcagcctcccaagtagttgggactataggcgcacactgccacgcccggctaattttttgtattttaatagagacggagtttcgccgtgttgcccaggctggtctcgaactcctgagctcaggcaatccgccctcctcagcctcccaaagttctggtatgagccaccacgcctggccaagctgggtcttttgaatggctatgggtgctcagtgaggcaaccctaggtgatatcataacacctctgcttatccagaagacaattagtatatatgttatcttgttagaatccatgtgccaaaaatagaaataggaaaggcaaataaggatatatccctagattgtcaaaatggtgattcagaattgtgtgagatactggtttactgcctacagtcacatcaaatgtgttacaatgagcatgtgtctgggggttcgtggagtaaaggtagggattatggatcaaggacaatgttacctcaagagcaaaggtcagagacatcaaaaataggcatcaacagttttaccatccttttccagatagtccattgttgcttgcaccaagttgagactttctttgcaacaaagaatgggggaaacatttaaaaggtaataactttccctacatgtgatctagtcttctttaatgcagtgccacgtgccaacaaaagtctcataaagcaccagtgatacagggtcttgctcaggaaatatgtgtaaaagaggggagctgctggacttcggagagctggggtccagtgtaggttctgtcactgtgagatcttcaaagtcacgcaaactcaagtttcctcttgcggtttttttcttccatggagcataatggaagtaagacatgatgtcagcacgcatgaacaacctgtttgaactcagtgtgctcatctcagcattaacagaaagtgcctttacaaaagctttggagacattaaacacgggccccagctggatgtggaaacatgtagggaagtacatgccatttgacaagtacctgtgaagatggctgtgaacagtcttcatcaggtgtgaatcggggatggattgactgccaaggactttagacttgataagttagagccttggaggccatttcagatagaaactcttcaagcatctatctagtctggtagggttgcggggtggagggccaggaatgccctgccaagtaaaatgtgatgcccgagaaggttcccaattcaggattccacctggctcccacgagccccgctgtctctcaggtgtgtggagtgtttctcagtgctcattgcaaggccaccctgaaaaggcccagcgggtgactgtcaggaccacaggactctcctggctcactacttccaaagtgctgagcgccagacagggctgcagagaaccccggaaagtgtgcattgtttccacattatttggagtttctcactcccatgttttttttttttttctcttctccttctccccgtgcccaactagctgctcctcctgccctgcaggcactcaagcaagaggcccgccagaggacagcaacactgatgtgcttcggtcgcctcccgcccctcctgccctccccacagatgatagcaaaagggaaattattttttcttggggctggctttggtcccccgtgttttcatgagtttgtttttgtgtctctcgaagccattttcagaggctctctggtaccgggtgttgagcccttgtcctgatgcaaggtcgggaaggggcgtgctccaggaataaaccagaaggaagggctggaggagcctgggaaccttgggataggagtgtgggcctcagtagttgagctgttttctcctggcctgggaaagaaacaaggggtgagggggtggaagtggggtccatgctgaggaaggggtgcaagtgcccaacacgatggcggtctctctctctatttttatctgggtgatgggtactaaagagcctctgtaaggggaagagaagaagtcacgcaagggcagcccagagcccgcagtttctttaatgggggagaagggcacatgagatagtcctcacagtttgacaaatgtggtgtgttgtaaggacgggagccttggttgcatttttggccctggcagggagagcctcccttccattgcagtgttccccgagtgtccgccaaactgcagccgtccagggaagagaaggattgagtgaagaacatgcattttggggtttgggatttttgttattgttgttagaaacagggtctcactgtgtcgcccaggctggagtgcagtggcatgatcatggctcactgcagcttcgaccttctggactcaagccatcctcccacctcagcctcccaagtagctgggattacacgcacacaccaccacgcccatctgctcctagtttttttctagataagcaacctgagacacaaaggataagcattagcagctcatacacgtgacagagccagattcagccttggcctgactgatttccacatccagaattcccctcatatagggagatagaaatctcaggatctcaacaaggtacaaataacgcacattcccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaattt
